United States Patent 6,812,339 (POLYMORPHISMS IN KNOWN GENES ASSOCIATED WITH HUMAN DISEASE, METHODS OF DETECTION AND USES THEREOF) - sequence listing, part 93

SEQ ID NO: 77072 - DNA, 601 bp, Human
agctatggcagccaccccctcaccctcttgtagcactgataagcacgctgggaagggggattgtcctcatttcatagattggagggctgaggccaggaaatgatttgaggactgaaagtaaattagccgagactggaagtcaggtttctaacatttaatctccacttagggaattggaggtcagaaatgaataaaataccatgccccagtaggctccagtctagggaagtgggcagcaggcagaaaccaagacacagaaagcaacgacacataacagatatgctatgatacaaatggtgcygcaggagctgcacagttcggaggccatttctggccagaggatgggatgcgtgaaatccaggaaggcttccaggaaggagtagctggcactgggatgggcaggaacagcaatgtctctactgatggtttcattggagaaagctggcaaagttgagaagtttggagaccaaccgtgacaaaatttaaacatcaggtatgtgaaggcaagggggaccaactgtgacaaaatgtaaacgtcaagtgtgtgaagtcaaaggggaaccaggaaagtaaaagagtgacaatcagcagtgcttttggc

SEQ ID NO: 77073 - DNA, 601 bp, Human; identical to SEQ ID NO: 30816

SEQ ID NO: 77074 - DNA, 601 bp, Human; identical to SEQ ID NO: 30817

SEQ ID NO: 77075 - DNA, 601 bp, Human; identical to SEQ ID NO: 30818

SEQ ID NO: 77076 - DNA, 601 bp, Human; identical to SEQ ID NO: 30819

SEQ ID NO: 77077 - DNA, 601 bp, Human; identical to SEQ ID NO: 30820

SEQ ID NO: 77078 - DNA, 601 bp, Human; identical to SEQ ID NO: 30821

SEQ ID NO: 77079 - DNA, 601 bp, Human
ttggagcagaggcctgaaaaatatgtccttgcatctctgctgttgcttctaccctttgtcaccgtgagaagtggacacctgggctggtttgctggtcccagaaggagagtgacaggcaagaggaaaagagatgagccacctccagtcacccttgcttaggctatcctacatcggctgatccccagacatctcattgagcctagccaaggtaagcagagctgcctggtgaccaccctggctgactgggcaatgaatgcagatagctgtctgccatgaggattcgtggctgtttgttacaccrcattgctatggcaatggataactgatacaacagcgggtactccatatctgtcaatcgaataaacaagtttctatttcattttgaaaaattagtggtttaataaattatcaactattcaaactacagtaccttctatacaggttttctacaaaaatgtatcttgcgctgtgaatcgacctctccatcaaccgtacagatgacacctaaaggaaaacaaaaagagaatcactaactcaggggaaaaggagacagccaggaggccttgagaaatgtctgttactccccctgcctggggacttt

SEQ ID NO: 77080 - DNA, 601 bp, Human
aggcaggaggatcacttgagcccaggagttcaagaccaacctgggcaatatgacgaaatcctgcctctactaaaaatacaaaaaaaatagccaggtgtggtggtgtgtgcctgtagtcccagctactcgggaggctgaggcaggacgatggcttgagcctgagagacggaggttgcagtgagctgagatcgtgcccccgtactccagcttgggtgatagagccagaccctgcctcaaaaaacaaaaaccaaaaccaaaaacgaaacaaagactaacaaggagcttgccctatctagacagsgtggtcggggagggctgggagacagggtggcatttaggaagacagctgcagatgagagtgggaggaagggcctccagcgttgacatccgaacagctctgcgagggaaggacagcagtatcccaagctcgcggcagggacaggtggggtctgcaacccatttccaagacccctagaaatcggcagtctctgagcacagggatggagggccccatgcctgagcccttggcactgacaggccaccagaagcccctaactaggtatacatcacagagtctgctctcatgagggaagcttttagt

SEQ ID NO: 77081 - DNA, 601 bp, Human
acagccccactctgcgaggttcataggtaatcccaccccactgccaagatctgttcctcaggctacagttctttttttgagacggagtctcgctctgttgcccaggctggagtgcagtggcgcaatctcggctcattgcaacctccgcctcgggttacagttctaatcagagcagtacacaaacataacagaggctcccttctgctctcgctctcctctgtcctgcctgtcctccctctggctgaggtgctaaggagcaggagctgaggaccgcagagggctggataaacctagcagtggrcacctggaaacccaggttgtcaggtgaaaatggggccgtaaggtcaggaatgccacctgctcagagggcaagctgcagcccacaagaaaagtctgaggccagggggcaaagccacggccaggactcaccttggctgccagcccctgagcccacagcattgctctgatgctctgggtggatttggggcagaggctctcattttggggggtgacacaggctcaaaggcatgatccatggcagctcagggctcctaggagaagcctttttagtggcccctcaaatgaaaggtgcaaaacagtg

SEQ ID NO: 77082 - DNA, 601 bp, Human
agcccaaagagcaagaacacccttcaagaaattttacttcgaggagatgcaggattccaatatgtgggcttttctggggacctgagcctgccatatagccttctgtctaggcccccacagatcctgaaccaaggttgcaagagcttctgagagggagaaaaagatcaacccaagcactgaaggggcaatggtaatgtgccctcccaccttgtgaagggctccccatcatggcattttgggaagccttttcctagagcatcccaggaaatgaggaaacacgagctcccaggcaggagctgaygccccacatgccaccgtgtggttcccagtacctggctgaactccctgcaggtgggaaccaagacaccttattctaggtatgggcaaaggacccagccaaagtcagttctatgctacattttgcataggtagtgacaatgacagtaatctgcattttgaaggagccgaaacctctaaaaacatctactttggccaggcatggtggctcacgcctataatcccaacactttgggaggctgaggcaggcagatcacttgaggtcaggagttcgagaccggcctggccaacatggtaaaaccct

SEQ ID NO: 77083 - DNA, 601 bp, Human
cctgccccttacacgttcctgtctttggccagacgcaatggctaacgcctgtaatcccagcactttggcaggctgaggcaggcagatcacctgaggtcgggagttcgagactagcctgaccaccatggagaaaccccatctatactaaaaatacaaaattagccgggcgttgtggcacatgactaatcccagctactcgggaggctgaggcaggagaatcgcttgaacccgggaggtggaggctgcagtgagccgagattgcaccactgcactccagcctgggcaataacagcaaaactcygtctcaaaaaaaagaaaaagaagttcccgtctttaaggatactgtgtaactggaatcttcctctccagcaattaacacagccctctcgaatccctggtggcataactgcagttacattctgcacaccccaacctcgccagggtagacagtgccagaagaggtgggtcttttccctggcgagctcttcatttgttcacagcccaaagagcaagaacacccttcaagaaattttacttcgaggagatgcaggattccaatatgtgggcttttctggggacctgagcctgccatatagccttc

SEQ ID NO: 77084 - DNA, 601 bp, Human; identical to SEQ ID NO: 30822

SEQ ID NO: 77085 - DNA, 601 bp, Human; identical to SEQ ID NO: 30823

SEQ ID NO: 77086 - DNA, 601 bp, Human
ctgctctctggagctggtctctggccctgggggcggggtggagttttcaatctgggatcctggggcttctggctccctcgcccataaagcgggacaaccttctctctgctgatcccagctttacatactggacactcttgccgttctggccgtgtctccagccactgatgaagacatggccaacagtacaggtggccacacacactgaccacagcttcccgagcagtctccaaacatatattacattcgaaggtcgcgcccgctccgccccgctcgcgatttggcccctcggggcccccgycctcctcctccgctgctgccatggccggttttgtttcgccccacgtacccttcagtccccccaaatacacatacacacgccccaacctgctttattattaccaagacgctcccactccttctcccaacagatttccatggtgcagcatcttccacaatgctttcttcacaccttgccctagagcagtaacaagctcaagaatttgagtgcccatagcatttttctccctggtctgtgtcactccaaaaagcctcattctgtgaaatatatggtggagctggcttcttggtagcctggcag

SEQ ID NO: 77087 - DNA, 601 bp, Human
tctgcgatgcagggcggcggcctgtaatcccagcgaccgccagggtgagtgtcccgcgctggccgctggctccgtagaagccgaactggagggccaggctgggctcggcgcctcgcctggggcaattcgcccacttgcctttcgccaacctcagaaccttcctttctggcctccgcctttccagttcagcctgcgcagcccgcgggggtcctgacaggtctctgactctgatgccttctgcagccctagcatggcccccgcgggaacttgtgggcacctcgcgggccggattgcacctctkaagcctaccgctttgtaccaaacaaaatgttacgtgcgcatcgcggtgtcccgcggttactcacctccgcggttggaaattgcggactccgcaaagttccagggtctttggagctttccagcgcaccttcatttagcacttggttgagattttcttggccttctttttcttactctcccaacttattttcttaaattttctaaaaggaaggaggggtgctactcactacggatcttttggaagaagtacgaaagtatccgacaatcattgaatgaacccagtttgggtccgaaaaacaaa

SEQ ID NO: 77088 - DNA, 601 bp, Human
cttttgagcccaatagttctaggctagcctgggcaacatagtgagctgtctgtaaaaacataggtttgaaaaaacctgtaacatgttcgtgacctcctgaaagaagtcggaagttgcagtcattcgagattttatgtaatataagctatagtaactatgctgtggatataaattagaatatattcgtatcttttatttgcaataaatgtaaagctgaatcttagaatttcaaacggataaattttaacagcactattcccagggcttttttggtagtgatagaaaagtgtaactgttgagyttttccatattggcaatatactgccaggttcccttatggacagaatgaatcatcggctgggtgcagtggctcatgctgctaatcctcaggaagattgtaaaccttaggacgctgaggtgggtggatcgcttcagcccaggagttccaagaccagcccgggcaacatggcaaaactgcctctctacaaaaaattagcctggtttggtgacgcgcgcctgtaatcctagcctgtactcaggaggctgaggtgggaggatcgcttgagcccaggaaattgaggctgcagtgagccttgagcat

SEQ ID NO: 77089 - DNA, 601 bp, Human
gagacctgtctcaaaaaaaaaaaaagaaaagaaaaagaaaaatgaatcatacgtttatactgtactccagaatccccaagtaagtttctaacacaattgtttctattgaccaagcaattttggcattttacactgaaattacagtggctgttaaatttagtctaaactgccctttaagtgttggcaaaaaggagaagaaacagtgtaatttgtaatccctcttctgtgtagctgtcattatgttgaaaattatgtattctttgtctcatctgtctgtgaaacacagataattattacctaycttagtggtcaaaatgactttgcaaagttgtttggaatgtttattactacaaaaaattaaaattttttttacacttaaaaatgcttagtaggtttttaaaaataactttgtgaaaatttagtttcagtaatgaagcatttcttaaaagggcaaccattattatggcaaaatttaaaaatcatttagaaaaagagtactatttaaattggatgcatgtgagaagactatttgaagaacttttggagaaagaaaatctaaaaacagttgtttttatttgtctagaagtaaggtttagtttat

SEQ ID NO: 77090 - DNA, 601 bp, Human
atgtgagaagactatttgaagaacttttggagaaagaaaatctaaaaacagttgtttttatttgtctagaagtaaggtttagtttatgcttctaaaatgcctgtggctgggaaaagcttataaagcataaggagaggaggaaaccttgagggattgcttgaatacttaaaaatgaggaatgcctttaaaggcaaaatagaaactgtctaaaagaaatatgagagccctgtttgtaattttgagttgtctgatagccacattaaaaaaagtaaaattaaagatgaattaattttaatatatyctagaattaattttaataacgaaatttatatattttaataataaaatatataaaatttaatactattttattaagtatattcaaaatatttcaacatgtaatcaatatcaaaattattgaagtattttacatcatctttttgtactgtctttaaaacccagtgagtattttacactttcagcacatcacagttcagactaaccacgttttaagtgctcagtaaacagtgactactcaattagatagtgtagttagagttagtatctaagttataaagaatttttacaaaccagtatacat

SEQ ID NO: 77091 - DNA, 601 bp, Human
gtgatgtatacaaccatttttttaaaaaattataattcagggctgggtgtgttggctcatgtctgtaatcccaacactttgggaggccgaggtagggggatcacctgaggtcaggagttcgagaccagcctggccaacatggtgaaaccccatctctaccaaaaatacaaaaactagctgggcatggtggcgggcgcctgtaatcccagctacttgggagactgaggcaggagaatcacttgaacccaggaggtggaggttgcagtgagctgagattgcgccactgcactccagcctgggygacgagcgaaactccatctcaaaagaaaaaaaaaagaagttataatttagaagaatagtgacatggaaaatactcttgtgttattaggtaaaaactgtagaaaaatacagtgaaaatatatactgtgatattaacagtgagtttgtctaaaaatttttttatttgtgttttacaaatgatctacagtacacatatacttctaaagaataaaaatgttacttagtttctgtagtaagtatatccttttttataaaaagttctttgggttaggatagagcacatatttctttttttcatgta

SEQ ID NO: 77092 - DNA, 601 bp, Human
tcatgcctgtaatcccagcaaaatttgggaggccaaggtaggtagataacttgagtccaggagtttgagaccagcctgggcaacatggcaaaatcccatctctacaaaaaaaaattaaaaaatgtagccaggtagggtggcacacgcctgcggtcccagctactcaggagtctgagatgggaaaaccacctgaggctggggaggttgaggctgcagtgaaccatgattgcaccactgccccagcctgggtgacagagcaacaccctgtctcagaaaaacacaggtgggtgcggtggctcaygcctgtagtcccagcactttgggaggccaaggagggtggattacctcaggttaggagttcaagaccagtctggcccacatggtgaaaccacatctctgctaaaaatacaaaaattagtcaggcgtggtggcacatgcctgtaatcccagctacttgggaggctgaggcaggagaatcacttgaacccgggaggtagaggttgcagtgagctgagatcacgccactgcactccagcctggatgacggagtgggactccatctcaaataaataaataaataaataaataaataaataaataa

SEQ ID NO: 77093 - DNA, 601 bp, Human
ggccattaggtcactagctacagaggccatgagagtaaaataaagacggagaagtgtggctgttctgagtagactgctgataggataccagtaactctgcagtcttgaagacacagcccttatatacacagccataaggaagttcttgtccaggccagtagaatagtaagtgccagagtaaagacttcgatatgtagcttgtttagaagtcaccttgaaaaaagaatattaatggtgggtaatatttttcactatctctttgcttactggaattaatgaattcagtaattctttttttttktttgtttttgagatggagttttacaccgtcaccctggctggaatgcaatggcgcgatcttggttcactgcaacctccgcctcccgggttcaagcgattctcctgcctcagcctcccgcatagctaggattataggcgcccaccgccacgtctggctgatttttttgtatttttagtagagatggggtttcactatgttggccaggctgatctcgaactcctgacctcgtgacctgcccagcttggcctcctaaagtgttgggattacaggcatgagccatgcaccctgcggaattcagta

SEQ ID NO: 77094 - DNA, 601 bp, Human
cattaggtcactagctacagaggccatgagagtaaaataaagacggagaagtgtggctgttctgagtagactgctgataggataccagtaactctgcagtcttgaagacacagcccttatatacacagccataaggaagttcttgtccaggccagtagaatagtaagtgccagagtaaagacttcgatatgtagcttgtttagaagtcaccttgaaaaaagaatattaatggtgggtaatatttttcactatctctttgcttactggaattaatgaattcagtaattctttttttttgtttgtttttgagatggagttttacaccgtcaccctggctggaatgcaatggcgcgatcttggttcactgcaacctccgcctcccgggttcaagcgattctcctgcctcagcctcccgcatagctaggattataggcgcccaccgccacgtctggctgatttttttgtatttttagtagagatggggtttcactatgttggccaggctgatctcgaactcctgacctcgtgacctgcccagcttggcctcctaaagtgttgggattacaggcatgagccatgcaccctgcggaattcagtaatt

SEQ ID NO: 77095 - DNA, 601 bp, Human
aagaactcatcaccacttaacaaagtagtgttgacctaataaaaatagcctgaagttagataaagcctttacagccattgatttatagaacatacagaagaatgggctaaacaataccataggaattcagtcagcaaaattcagcctgggaaactaccaggacaaaaattcaggacaaacaacctggctttttcaacataaaaattgcagttaaaaaaaaaaaagacattctgtagcttaaaagagacttaaaagacatctcaattagtcccaatatgtggactttatctggatctattcmcatagaaactggaaaaaaattgtaacatttgtaacaactggaaatttgaaattgagaatatttgatattaaggtttttttttaatttctggtaatggtgttatggttgtgttaaagtttttgtctcttataaatacatactgaaatatttatggatgaaattatatctgagatttgcttcaaattaatattggtgcaggtagagatgagatgaaattgtccatgagttgatcattgttgaaagtaggcaatgggtacgtggcagtttattgtgctggtttttctacctttgcatacgttt

SEQ ID NO: 77096 - DNA, 601 bp, Human
ctatctgtaatgatgtaatttgatttcacctaaaactttacaaaatatatgaatgatatctatatagggtttttgggttctttcaaaaagaggaattatcagtactcatggtaaaaaaagagaaggagggtcacaggaaaataggaacaaatttggttttctagtacttgggtaaattgtggaatatactttccttctgtatttgagcccttcaaagctcacagtcaacccagatgaagcagctgaagtgctttgtaattagtcttctattcttcactcaattaaaattccccatttactraggcatctcaccaaatgttgatctaattatctgattaaaaaatcggtgacagtatgaatgaatgattaatataattcacttgattgtgaaatgaaagaggaataaatctttagctagtggaagaaggacacaggataattttgtgtaggaagtcttcctgaccttccctcccagagtcctttattctgaaaagtaattatgccaacatttttttagcttgcaaccagcatgcaaaataaagagtatctactatgtactatatacctttcaaaatagctgaatagcataaatattttattt

SEQ ID NO: 77097 - DNA, 601 bp, Human
acccagatgaagcagctgaagtgctttgtaattagtcttctattcttcactcaattaaaattccccatttactaaggcatctcaccaaatgttgatctaattatctgattaaaaaatcggtgacagtatgaatgaatgattaatataattcacttgattgtgaaatgaaagaggaataaatctttagctagtggaagaaggacacaggataattttgtgtaggaagtcttcctgaccttccctcccagagtcctttattctgaaaagtaattatgccaacatttttttagcttgcaaccarcatgcaaaataaagagtatctactatgtactatatacctttcaaaatagctgaatagcataaatattttatttgattttttatatttttaaaaatttccaaataagtttacaagttagagaaaattagaatgttgtcactaatttttctttacaaaatggtatttcatgtgtacctagaagcagtgaaacacctctggagagggtggcttggcaattaattatgcagctaggacttggtttgaaattaaagtatatatattttttcttttagagtggcagaatttagtgacatttggaag

SEQ ID NO: 77098 - DNA, 601 bp, Human
ctttgtaattagtcttctattcttcactcaattaaaattccccatttactaaggcatctcaccaaatgttgatctaattatctgattaaaaaatcggtgacagtatgaatgaatgattaatataattcacttgattgtgaaatgaaagaggaataaatctttagctagtggaagaaggacacaggataattttgtgtaggaagtcttcctgaccttccctcccagagtcctttattctgaaaagtaattatgccaacatttttttagcttgcaaccagcatgcaaaataaagagtatctaytatgtactatatacctttcaaaatagctgaatagcataaatattttatttgattttttatatttttaaaaatttccaaataagtttacaagttagagaaaattagaatgttgtcactaatttttctttacaaaatggtatttcatgtgtacctagaagcagtgaaacacctctggagagggtggcttggcaattaattatgcagctaggacttggtttgaaattaaagtatatatattttttcttttagagtggcagaatttagtgacatttggaagcttttcaaacgtggttccctgta

SEQ ID NO: 77099 - DNA, 601 bp, Human
aaagagtatctactatgtactatatacctttcaaaatagctgaatagcataaatattttatttgattttttatatttttaaaaatttccaaataagtttacaagttagagaaaattagaatgttgtcactaatttttctttacaaaatggtatttcatgtgtacctagaagcagtgaaacacctctggagagggtggcttggcaattaattatgcagctaggacttggtttgaaattaaagtatatatattttttcttttagagtggcagaatttagtgacatttggaagcttttcaaacrtggttccctgtagtcatccatatattggtaccctgagtcaagtaaagttgtactccacaaatgttcagaaagaaggacagggatcacaaacactcagagtggaaaaagtaccatcatttgaaacaggtatgtgtaatttttttaatgtacttttttctgtatactggaatagtttgtgtaaaattatttgttccctggatgtttgatagaacttacttataatactgtctggactgatgttttctttgtgggaactattaaagcacttatttaatttctttattttttctatttcttttt

SEQ ID NO: 77100 - DNA, 601 bp, Human
ctagaagcagtgaaacacctctggagagggtggcttggcaattaattatgcagctaggacttggtttgaaattaaagtatatatattttttcttttagagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacaggtatgtgtaatttttttaatgtacttttttctgtatastggaatagtttgtgtaaaattatttgttccctggatgtttgatagaacttacttataatactgtctggactgatgttttctttgtgggaactattaaagcacttatttaatttctttattttttctatttctttttgactcagttttctacgaaaaactatctacttatctacttaaactaaaattttaatttattggtataaagtgtataataatgttccctgtttactcccaatagcatatgtagttatgtccttttttcattcctaatatttgtcttattttcttggctagtcttcc

SEQ ID NO: 77101 - DNA, 601 bp, Human
tagaacttacttataatactgtctggactgatgttttctttgtgggaactattaaagcacttatttaatttctttattttttctatttctttttgactcagttttctacgaaaaactatctacttatctacttaaactaaaattttaatttattggtataaagtgtataataatgttccctgtttactcccaatagcatatgtagttatgtccttttttcattcctaatatttgtcttattttcttggctagtcttcccagaggtttgtgttttattatttttccaagtaattttttttttactttgaaccattatatgtttgtatcctatttcgtcaatttttactttttaattatagcctcctttctgcctttttttgggtttgttcagtcattattttttgttttgttttataacttcaacttttgtttagattcaggagggtacatgtgagggtttgttacatggtattttgtgtgatgatgaggtatgaggtacacgtgatctcatcacccagatagtcagcatagtaccaaatagtttttcaaccattgctgccctctctctctctccctcatctagtagtccccattgcctatt

SEQ ID NO: 77102 - DNA, 601 bp, Human
atgtggtacttggttttttgttttctgtgttaatttgcttaggataatggcctctagctacatccatgttgttgcaaaggacataattcattcctttttgtggctgcatggtattccatggtgtatatgtaccatatttactttatccagtaccccattgatggacacctaggttgattctaagtctttgctattgtgaatagtgctgcaatgaacatatgagtgcatgtgtctttttggtagaataatttatttctttttgatatacactccctgatgggattggctggagttctttgasaaatctccaaactgctttccacagtggctgaactaacttacattcccaccagcagtgtattaagtattgacttttctctgcagtctcactagcatctcttgttttctggttctgtcattctgttattaattgtcagttagacacttagtttattaacccttccttcctttctgaagtagacatttaagccatgataacacatcccacagttttgatatataatatttttattatttgtaaatctaaatgtattcttatttctattgtgattcttctatgactttttagttgttaaagcat

SEQ ID NO: 77103 - DNA, 601 bp, Human
ttatccagtaccccattgatggacacctaggttgattctaagtctttgctattgtgaatagtgctgcaatgaacatatgagtgcatgtgtctttttggtagaataatttatttctttttgatatacactccctgatgggattggctggagttctttgagaaatctccaaactgctttccacagtggctgaactaacttacattcccaccagcagtgtattaagtattgacttttctctgcagtctcactagcatctcttgttttctggttctgtcattctgttattaattgtcagttagayacttagtttattaacccttccttcctttctgaagtagacatttaagccatgataacacatcccacagttttgatatataatatttttattatttgtaaatctaaatgtattcttatttctattgtgattcttctatgactttttagttgttaaagcatcattgtaaatttacagatagatggaatttttgtttatctttttgtatttaatgtatttcacaaaatgtggtctgtattgattcagtcttgaaatttgttgagtgtaacattttagtttagcaattggtcagtttttctaaat

SEQ ID NO: 77104 - DNA, 601 bp, Human
tgtgcatttactgtaatcactgatatagttaaacatatttctaccattttatcatgtttccttgtcctgttttcttaaattccttttttgcctttaattttttttcctcattccgtcatcctttctcctctattctctttctctcatttgaaagttttagactctgtgtctgtacttcaaagcctaaagttaattgataaatttactttccttctgaaaaacacaaaagctttagagtgctttaattctgatcaccgcctccaacttatgtgctatttgttggctaatattttctgtctaytctgctctttctctgctataaagtatgcattgttgcttgcttagatttattcagaatctttgttagccatcttttcttatgtctgatctttctgtctgatgtacatcctatacaagttcgtttaggtgaggatcttttgtgggaaaggcacatttaagatgttactcgattgttttttggcttccactaattgttgagaagtcagatattatgcctttgtttgtatattttttctatttgacagcattttaaatttgattagctttaatttgaaagtctttttctttggtataaatggca

SEQ ID NO: 77105 - DNA, 601 bp, Human
tttcttaaattccttttttgcctttaattttttttcctcattccgtcatcctttctcctctattctctttctctcatttgaaagttttagactctgtgtctgtacttcaaagcctaaagttaattgataaatttactttccttctgaaaaacacaaaagctttagagtgctttaattctgatcaccgcctccaacttatgtgctatttgttggctaatattttctgtctactctgctctttctctgctataaagtatgcattgttgcttgcttagatttattcagaatctttgttagccaycttttcttatgtctgatctttctgtctgatgtacatcctatacaagttcgtttaggtgaggatcttttgtgggaaaggcacatttaagatgttactcgattgttttttggcttccactaattgttgagaagtcagatattatgcctttgtttgtatattttttctatttgacagcattttaaatttgattagctttaatttgaaagtctttttctttggtataaatggcagttttattatgaagtaactaggtatgtatttctttgtatttattctacttgagatttgttgggcttcctg

SEQ ID NO: 77106 - DNA, 601 bp, Human
cctctattctctttctctcatttgaaagttttagactctgtgtctgtacttcaaagcctaaagttaattgataaatttactttccttctgaaaaacacaaaagctttagagtgctttaattctgatcaccgcctccaacttatgtgctatttgttggctaatattttctgtctactctgctctttctctgctataaagtatgcattgttgcttgcttagatttattcagaatctttgttagccatcttttcttatgtctgatctttctgtctgatgtacatcctatacaagttcgtttagstgaggatcttttgtgggaaaggcacatttaagatgttactcgattgttttttggcttccactaattgttgagaagtcagatattatgcctttgtttgtatattttttctatttgacagcattttaaatttgattagctttaatttgaaagtctttttctttggtataaatggcagttttattatgaagtaactaggtatgtatttctttgtatttattctacttgagatttgttgggcttcctggatctgaggattgatatttttctacagttctggaattctacaattctcttattatc

SEQ ID NO: 77107 - DNA, 601 bp, Human
gtgaattcagactgtgacttgtgttagggtccacttgtctgtaggattttcagaggagtatttttttcttccccactatttaacaccaaaatacagataggccagcttacttgctgttcccttctatgtgtattatttatttctagttcatagtgatcccatggctgtggctttttacctcagtgtcccctgttagactccttatcttggcagaacctagtcttattctctggtcttccatgcccgttgtagctctggaggtagaaataagctcaaagaatccaagcttcaatagaaatcsggggaaagctggctttgatatgttcatttgttctgtagagattctgctttcacttcatttttggccttttcgtatcattttttgctagactaacaatgcatttaaaaagattttgcttggggtacaataaaaggaagcattaaaggaagtcctttattcatttattcattaatttactcaagaaatatttattgagcactttttatatggcagcaaatgagaatgactcagagttgattactaaagcagaaaattaagcaaacaaatattgtattgtaacatttagccctgtattcatgt

SEQ ID NO: 77108 - DNA, 601 bp, Human
ggtattggccaggtgtggtggctcacacctgaaattctagcactttgggagaccaagtgtgtggatcacttgagcccaggagttcgagaccagcctgagcaacgtggtgaaactctgtctctacaaaagatacaaaaattagctgggcatagtggtgtgcacctatagtcccagctactcaagaggttgaggtaggagggtcaccttagcctgagaagtcaaggttgcagtgagccatgatagtgccactgcactctagcctgggcaacagagtgagaccctgtctcaaaaaaaaaaaaaagtaggtatggatgtgtggtgaatggtggaaaaaggaggtaaaattcctggaatagtgagtagaggatttggcggtggggttggtagtgttgaaagtacaagagacgatgatccagcttccatattccttttaatttttttctactgctctcttgcttgctcactatgtttcagccaaagcagtctccctttttctcagccatgttctgagaaaatggcaagagttaagcactagtcagatcggggtcttgttcgggagtttggactttgttttgtaggtagtgggaataacagagtatta

SEQ ID NO: 77109 - DNA, 601 bp, Human
tgaaactctgtctctacaaaagatacaaaaattagctgggcatagtggtgtgcacctatagtcccagctactcaagaggttgaggtaggagggtcaccttagcctgagaagtcaaggttgcagtgagccatgatagtgccactgcactctagcctgggcaacagagtgagaccctgtctcaaaaaaaaaaaaaagtaggtatggatgtgtggtgaatggtggaaaaaggaggtaaaattcctggaatagtgagtagaggatttggcggtggggttggtagtgttgaaagtacaagagacgrtgatccagcttccatattccttttaatttttttctactgctctcttgcttgctcactatgtttcagccaaagcagtctccctttttctcagccatgttctgagaaaatggcaagagttaagcactagtcagatcggggtcttgttcgggagtttggactttgttttgtaggtagtgggaataacagagtattattaatacaagtaggggaggtacttgatcagatttaaggttttagaaagataactagttgcaaaatgtcaaacaggttgcaaaggagggagattgaaagtagtagtac

SEQ ID NO: 77110 - DNA, 601 bp, Human
ctctagcctgggcaacagagtgagaccctgtctcaaaaaaaaaaaaaagtaggtatggatgtgtggtgaatggtggaaaaaggaggtaaaattcctggaatagtgagtagaggatttggcggtggggttggtagtgttgaaagtacaagagacgatgatccagcttccatattccttttaatttttttctactgctctcttgcttgctcactatgtttcagccaaagcagtctccctttttctcagccatgttctgagaaaatggcaagagttaagcactagtcagatcggggtcttgttygggagtttggactttgttttgtaggtagtgggaataacagagtattattaatacaagtaggggaggtacttgatcagatttaaggttttagaaagataactagttgcaaaatgtcaaacaggttgcaaaggagggagattgaaagtagtagtacaaatgaaggtctagagtagggtaataataatgcttttttttaaaggagtagatgaccttaagagatctaggagctgaataattaggacttagtaattgaatctgggggatgaagaagagggtcaagccaagggcaatgcttggtta

SEQ ID NO: 77111 - DNA, 601 bp, Human
gccagctgtctagatgatttcattgatttctaaaattaggagtaccagagctggagtatattttaatgagatgatggcttggtttgcacatctgaattataggtgcctatggaaggtcttaacagatgatgcagtgaccaataggcagttggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaasccggtgaaaccccatctctactaaaaatacaaaaaattagccgggcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcgtctgatttactgtggtagtattctccctgggatctctgcttccattcttg

SEQ ID NO: 77112 - DNA, 601 bp, Human
ccagagctggagtatattttaatgagatgatggcttggtttgcacatctgaattataggtgcctatggaaggtcttaacagatgatgcagtgaccaataggcagttggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaagccggtgaaaccccatctctactaaaaatacaaaaaattagccgagcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcgtctgatttactgtggtagtattctccctgggatctctgcttccattcttgtccttctgtagttcatttttcacgtaacaagtgtggtcttttta

SEQ ID NO: 77113 - DNA, 601 bp, Human
agagctggagtatattttaatgagatgatggcttggtttgcacatctgaattataggtgcctatggaaggtcttaacagatgatgcagtgaccaataggcagttggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaagccggtgaaaccccatctctactaaaaatacaaaaaattagccgggcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcgtctgatttactgtggtagtattctccctgggatctctgcttccattcttgtccttctgtagttcatttttcacgtaacaagtgtggtctttttaaa

SEQ ID NO: 77114 - DNA, 601 bp, Human
tggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaagccggtgaaaccccatctctactaaaaatacaaaaaattagccgggcatggtggcacgcacctgtagtcccagctactcgggaggctgaggcaggagaatcgctcgaacccaggagggagaggttgcagtgagctgagatcgcgccactscactccagcctgggcgacagagcaagactccatctcaaaaaacaaaagatgtcacacatcttaacacaactactatcctacttcaagatatcattatctcgtctgatttactgtggtagtattctccctgggatctctgcttccattcttgtccttctgtagttcatttttcacgtaacaagtgtggtctttttaaaaacagatcatgtcacttttttaattaaaactctccattggcttctagttacccatagaacaaagccaagactgctagaataaaattaaaatttactattctga

SEQ ID NO: 77115 - DNA, 601 bp, Human
gacagtgtttagagtgaggagagatcttctagtacaaaatcccccacatgggtgagggacaggtagaagaggagcctgcaaagcagacttgagaaggagtggctggagaaaatccagactatctggtgtcaggagaagacagtgtttgaagaataataaacatttcaagaccatttttcctttagttagatgtctttcacaggggaagattttacagattccttgagaaacctgtatacatttaatggctccttgttttcattctttttcctaagcctcatcctccctttgggtttacctrtgcaatttcttctctttcttttgtggtgatggagaactgctggggtaaatattgattgagagtttgattttatgcaatgaaagaatgcagagtgtaatgagtccctaagttccagaaataagcatgtttattagaacacagttaagggaaaagaaatagtgatgaaataatataattaagggtaaaatatgttacaatgctctgcagaggtgaacacagactcaggggaaaatatttaatatggttccaccattcagaatctttcaaattgaaatccatgattaagtttcttttttctct

SEQ ID NO: 77116 - DNA, 601 bp, Human
cagatgtgtggcaaacagccagggtttgagcttaaaacaaatgtctagcgatattcatggatagaatgtttggttactgattgaaatcataaagattctactgcagtgatgcagtgtgagtttattaagttggtgctatgtaaaataagtattcatacatgtgtttaagccatttactagcattcttgtttgtgctgtataacactatatatttagtaacatctagacagtttgtagtgagaagaatatccagaaatatacagcttaaagcaactcattttatgtgattaagttcaataaygttgagcattgtagaaactagggttgtttctgaaacttttgacagtagatatcagttgtttggacattaggtaagttttgaaaatgtattattccacctttttcccttcactcctctctgccctgctctctgtttcccaaagctaaattgtaagaagtggatgtgtaggttctatagataaagatactttagaatttgcttgctgtgtagcgagacaaaaataaaatcataataatttaattttttaaggtcaaatgtagttactaaatagaagtgtttttaagcttatcttcaatttac

SEQ ID NO: 77117 - DNA, 601 bp, Human
catgtgtttaagccatttactagcattcttgtttgtgctgtataacactatatatttagtaacatctagacagtttgtagtgagaagaatatccagaaatatacagcttaaagcaactcattttatgtgattaagttcaataacgttgagcattgtagaaactagggttgtttctgaaacttttgacagtagatatcagttgtttggacattaggtaagttttgaaaatgtattattccacctttttcccttcactcctctctgccctgctctctgtttcccaaagctaaattgtaagaartggatgtgtaggttctatagataaagatactttagaatttgcttgctgtgtagcgagacaaaaataaaatcataataatttaattttttaaggtcaaatgtagttactaaatagaagtgtttttaagcttatcttcaatttactagtatgacatcataacctacttaggatttggcaaacacttaaagcctttttagattttctgtacatgctttaggtaccaaaacgtactgtattttggtcaagtgaagtggctcacacctgtaatctagcactttgggaggccaaggtgaaggatcc

SEQ ID NO: 77118 - DNA, 601 bp, Human
ttgaaaatgtattattccacctttttcccttcactcctctctgccctgctctctgtttcccaaagctaaattgtaagaagtggatgtgtaggttctatagataaagatactttagaatttgcttgctgtgtagcgagacaaaaataaaatcataataatttaattttttaaggtcaaatgtagttactaaatagaagtgtttttaagcttatcttcaatttactagtatgacatcataacctacttaggatttggcaaacacttaaagcctttttagattttctgtacatgctttaggtaycaaaacgtactgtattttggtcaagtgaagtggctcacacctgtaatctagcactttgggaggccaaggtgaaggatcccttgaggtcaggagtttgagaccagcctgggtaacatggggagggagaccctgtctctacaaaaaataaaagaattatccaggtgtggtggcatgtgcttgtagtcccagctacttgggaggccgagacgggaggatcacttgagcccaacaggttgaggctgcagtgagccctgattgtgccactacactccagcctgggcgacacagcaagatcctgtc

SEQ ID NO: 77119 - DNA, 601 bp, Human
cagcctgggtaacatggggagggagaccctgtctctacaaaaaataaaagaattatccaggtgtggtggcatgtgcttgtagtcccagctacttgggaggccgagacgggaggatcacttgagcccaacaggttgaggctgcagtgagccctgattgtgccactacactccagcctgggcgacacagcaagatcctgtctcaaaataaaataaaataaaataaaataaacacacacacagtatttggtcattttcctagtggttttcactgaaaaacaattgccaagaaatatactaaaamttacctgtaaaatattttgcttttatttcaaatagggctttgcttttgttagtgcttaatatattggcatttaattgcttcatataagctttgaaagaggtaactcaatggataggcagaacttctgatcacagtggtattgtgaatacatactttgaggcatgtgttctactaaccactcattggaataatagataaagtataaaaagagaaaattgaagacatagttggactaaaaaaagacatgttatatcaaagaaatggaacagaagcatctggactctgggtctgtaatctggg

SEQ ID NO: 77120 - DNA, 601 bp, Human
gtacccataaaaaattaaaatataaaagcaaatttaaacaaaaacccaaaaaataataaaaagttttttttaaagaaaaataatgttaaacaatagaaatacagtcttataaattccaaatagcaattgggggattggatgggaggcgaatatagaaaactttttcaatctaagagatggagacggcaggaaaagcgaaataaaaataaaagcaaagaaaacaagatggtaaactgaaaacaataagatggcagaagtacaaatgtaccacagttaagtagtcagacttagtggtgttccrtatcatttaaatgaactcataatctaaatatgtggaattagttaatttctgtttcattccatgttttcagagacttatattctggatcccctactaccccatctgctcaaggactttgcttttgggattatcctgttagcctactttatattttcttcgtggttattgcatcattcctatctctatgtaaaatgcagtcaacctttccttgattcattctcttcagctcctgctgaaagtccaaataccgcttccatttaatctcctattttctcctcaactattgtgtccattcccatt

SEQ ID NO: 77121 - DNA, 601 bp, Human
ccgtatcatttaaatgaactcataatctaaatatgtggaattagttaatttctgtttcattccatgttttcagagacttatattctggatcccctactaccccatctgctcaaggactttgcttttgggattatcctgttagcctactttatattttcttcgtggttattgcatcattcctatctctatgtaaaatgcagtcaacctttccttgattcattctcttcagctcctgctgaaagtccaaataccgcttccatttaatctcctattttctcctcaactattgtgtccattcccrttcttgtccagaaactgctgttttcaggaggttccagtgatcttcatgttggtaatctagtatctattcttttttttaccacctagaaaaatacacaaatacctacacataaaattaaatattgttctaaacacaggcaatacaggaaggtggttaagagtgtagagtaatcaaaataactgtgcctccatgtttaaaatactagctgcgtgactttgggagaatttacaaaacctttctatgccccagtttcctcataacaaggaaaactggctctgtgactttgggggaagttataat

SEQ ID NO: 77122 - DNA, 601 bp, Human
gttttcaggaggttccagtgatcttcatgttggtaatctagtatctattcttttttttaccacctagaaaaatacacaaatacctacacataaaattaaatattgttctaaacacaggcaatacaggaaggtggttaagagtgtagagtaatcaaaataactgtgcctccatgtttaaaatactagctgcgtgactttgggagaatttacaaaacctttctatgccccagtttcctcataacaaggaaaactggctctgtgactttgggggaagttataataatctctgtgcctcagtttyctcataagatgaagataatagtattttcctcagagcaattttgtgacaattaaatgaaataatttgtaaagtgcataggacagtacatggcacatgttaaatgcttagtatatatagccattcttcataaactctgaaatgttattgaatgaggatataaatataatggaaaatgttttaagggtgagatttttacaatatatttgatacatacaaaaggatattataatacatatgtaagttaacaacataataaaatcaaaccttggaatttactactcaagctaagaacttcactgt

SEQ ID NO: 77123 - DNA, 601 bp, Human
attaatgttcttggagataattatagcacatactgttcagggatgttgtatgagttaaatgagttgatacatgcttagagtagtacttagcacacagtaaaagctcaaagaaagatggccattattatgtttgttactatgcactgctgtatgaaatgttgtgtgaatataacatggtctatctgtctatctatctatctatctgttctcttgctaatgggcatttgggttgttgccagtttacaacaacagaacagagtcctgctctgaacactcatgtacctctgtccttgtgccctcrtgcaagagtttcttgaagccaaatatattgacctagaagaattgctgggtcataaattatgcttgtgttcaactatagtagataatgccaacttgtttaccaaggtattgtgcccatttatatttccaccagcagtgtatgcattttcattgttccatacccttgccaacattaggtattctcatattttcctttttcttgatctgatggttataaaatagcatcttatgatttcatttggattctattaataatggggcagacattttttcaaatgtttattggttatttgtatatcct

SEQ ID NO: 77124 - DNA, 601 bp, Human
acccttgccaacattaggtattctcatattttcctttttcttgatctgatggttataaaatagcatcttatgatttcatttggattctattaataatggggcagacattttttcaaatgtttattggttatttgtatatccttttctgtgcaagattgtccttcctattttttctaatggattgtcatttttttgatctagaggacttatttaaatattcttgattacttttgttgattctatttgttggaaatatcttctctcagtttgcggcctttcttttttctctgtttttttttttatgggattacttgatgaacagtttttctgagttttaatttggcagaaatttatccagtttttcttgtgttgtttatatcttgtttaagaaatctttctgtaccataaaagtattctgtattatctactataaggcatgtaaataccttaacatttaaataattaattaatctacctgtaattgttttttctttatggtgggaggtagattcaaattttttaaatttaatgtgttttttggtaggtgtagggttgtacagttgtcccagtcccacttaataatcattctttattgattgaa

SEQ ID NO: 77125 - DNA, 601 bp, Human
atttggattctattaataatggggcagacattttttcaaatgtttattggttatttgtatatccttttctgtgcaagattgtccttcctattttttctaatggattgtcatttttttgatctagaggacttatttaaatattcttgattacttttgttgattctatttgttggaaatatcttctctcagtttgcggcctttcttttttctctgtttttttttttatgggattacttgatgaacagtttttctgagttttaatttggcagaaatttatccagtttttcttgtgttgtttatrtcttgtttaagaaatctttctgtaccataaaagtattctgtattatctactataaggcatgtaaataccttaacatttaaataattaattaatctacctgtaattgttttttctttatggtgggaggtagattcaaattttttaaatttaatgtgttttttggtaggtgtagggttgtacagttgtcccagtcccacttaataatcattctttattgattgaatggtatctctggtacagttttaaatagaagaactgtgcattcttttgttccttaatttaaaaatgcatttaaacatt

SEQ ID NO: 77126 - DNA, 601 bp, Human; identical to SEQ ID NO: 34493

SEQ ID NO: 77127 - DNA, 601 bp, Human; identical to SEQ ID NO: 34494

SEQ ID NO: 77128 - DNA, 601 bp, Human; identical to SEQ ID NO: 34495

SEQ ID NO: 77129 - DNA, 601 bp, Human; identical to SEQ ID NO: 34496

SEQ ID NO: 77130 - DNA, 601 bp, Human; identical to SEQ ID NO: 34497

SEQ ID NO: 77131 - DNA, 601 bp, Human
taatttcatcactggagtcagagcgataaatgagttctgcctcaaatccaggtaatttttttaaaaaatgtagccgtgtgtcatatctaaataatctaaataactattcctttcttagagtgtgttacctgctaccatccatatatggaaaatttgctactggctccttaaaatgaagagatatttttattcagtcaaaaatgttaaaaattgttagcaaactaaactgaatcctgccccagcattagcaattctagtctttcttagtttcttaaacccacaatggtaaattcttcaaaasctttccatcacacaagaatcttaggagttaaattgttaagtcattggtatgtgacagaattctcaataagattatttgcgtatttgtatgtttgactgttttggttttttggccagcagagttgagtacttaatttagtgagttaaatttatgttcatgctcccaactgtgatttctgttgagtataaattatttttactactttccaatatctgttattattaattttctcatatttatatttattgaaattatgttagtcacagatttaaacttttctccctcctttgtgcacgaatt

SEQ ID NO: 77132 - DNA, 601 bp, Human
ttatacttgttataaaagtgatagaataggaagtaattgctgtattagtctgttttcacactgctataaagatactacccaagactgggtagtttataaacaaaggagatttaactgactcacagttccgcatggctggagaggcctcaggaagcatacaatcatggcgcaaggggaagcaggcgcatcttaacatggtgtcaggcgagagacagcgtgtgtgtaggaggaactgtcaaacacttataaaaccatcagatctcgagaactcagtatcatgagaacagtatgggggagaccrtccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtttatagtcccagctacttgcctgtaatcccagctactc

SEQ ID NO: 77133 - DNA, 601 bp, Human
gaataggaagtaattgctgtattagtctgttttcacactgctataaagatactacccaagactgggtagtttataaacaaaggagatttaactgactcacagttccgcatggctggagaggcctcaggaagcatacaatcatggcgcaaggggaagcaggcgcatcttaacatggtgtcaggcgagagacagcgtgtgtgtaggaggaactgtcaaacacttataaaaccatcagatctcgagaactcagtatcatgagaacagtatgggggagaccatccccatgatccagtcacctccyaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtttatagtcccagctacttgcctgtaatcccagctactcaggaggctgaggtgggaggatca

SEQ ID NO: 77134 - DNA, 601 bp, Human
gaagcaggcgcatcttaacatggtgtcaggcgagagacagcgtgtgtgtaggaggaactgtcaaacacttataaaaccatcagatctcgagaactcagtatcatgagaacagtatgggggagaccatccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccratacccgctatgaacaagaagctgtgcttggtgtttgaaatgtatatgcaagtaagactcttaggagccaggtgtggtggcacatgtttatagtcccagctacttgcctgtaatcccagctactcaggaggctgaggtgggaggatcacttgagcccaggagtttgagaccaccctgggcaacatagacataaatggggtgataccatacatattgtacatcttgctctttatagatagtggtataatcataaccgttttccatatctacatatagaaatctacctcattctttttaaca

SEQ ID NO: 77135 - DNA, 601 bp, Human
gagaactcagtatcatgagaacagtatgggggagaccatccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtytatagtcccagctacttgcctgtaatcccagctactcaggaggctgaggtgggaggatcacttgagcccaggagtttgagaccaccctgggcaacatagacataaatggggtgataccatacatattgtacatcttgctctttatagatagtggtataatcataaccgttttccatatctacatatagaaatctacctcattctttttaacagttgtatagtaccccattgtatggatgtagcaagatttatgttcttcagtttttcactgttagaaagaatacatcaataaatattttt

SEQ ID NO: 77136 - DNA, 601 bp, Human
gaacagtatgggggagaccatccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtttatagtcccagctacttrcctgtaatcccagctactcaggaggctgaggtgggaggatcacttgagcccaggagtttgagaccaccctgggcaacatagacataaatggggtgataccatacatattgtacatcttgctctttatagatagtggtataatcataaccgttttccatatctacatatagaaatctacctcattctttttaacagttgtatagtaccccattgtatggatgtagcaagatttatgttcttcagtttttcactgttagaaagaatacatcaataaatatttttatttttttaacgtgagat

SEQ ID NO: 77137 - DNA, 601 bp, Human
ctactgaggttatcttctatgtatagtggtttttcttagttcttctgtaataatttttatatgttttgttcacttttctattagattgtgtgtctcttaaaattgatttaaataagtttttggtggattttaaccaaaatctaaccaagttagtttcatatgttctaaatattttctaacagtctatcttgaaatttggtttctcctctttttagtagggaaatttcaaacatattcagaagtgcagagaaaaacataataaccttttaatgcccatcatctggctttacagctaccaacacatggccagccttgtttaatgtatatccctctcactaaccttcactctactggattactttgaaaccaggtccagacattatatcattttatttataaatattccagtatatattaaaaggtcaggatgtttgttttagtcagttcatgtgatggtgatggttgaactgttttagaaaagttaactatccattgcctgtagtaagctgtcagtcttagtaatcctctcatttgccctttggttgaaggtctaggatgttctcaaatagctttaattctgacaaagaaagtgattgacctt

SEQ ID NO: 77138 - DNA, 601 bp, Human
gtatatccctctcactaaccttcactctactggattactttgaaaccaggtccagacattatatcattttatttataaatattccagtatatattaaaaggtcaggatgtttgttttagtcagttcatgtgatggtgatggttgaactgttttagaaaagttaactatccattgcctgtagtaagctgtcagtcttagtaatcctctcatttgccctttggttgaaggtctaggatgttctcaaatagctttaattctgacaaagaaagtgattgaccttctgttgatgattccttttctwgacaaaactgaaaatagtatgtctcttttcagctaacctagtcaggaggaataaggagtatatttgtgtgacctggaatatataatattaaatcatctagttgttgaataagtatagttttccttgtaaaatccaagttctttaaatcattggtttggcattttcaaaagtttgaaggagacagtgaatcctagtatcaaaggatttttggcctcagaaaaagttgttgattatttttattttattttatttttcgagacagagtcttgctgtgtcacccaggctggagtgcagtggtgc

SEQ ID NO: 77139 - DNA, 601 bp, Human
ctagacaaaactgaaaatagtatgtctcttttcagctaacctagtcaggaggaataaggagtatatttgtgtgacctggaatatataatattaaatcatctagttgttgaataagtatagttttccttgtaaaatccaagttctttaaatcattggtttggcattttcaaaagtttgaaggagacagtgaatcctagtatcaaaggatttttggcctcagaaaaagttgttgattatttttattttattttatttttcgagacagagtcttgctgtgtcacccaggctggagtgcagtggygcaatctcagctcactgtaagctctgccttccgggttcatgccattctcctgcctcagcctcccaagtagctaggactacaggcacccgccaccgcgcccaactaattttttgtatttttagtagagacagggtttcaccgtggtctcgatctcctgacctcgtcatccgcccacctcagcctcccaaagtgctgggattacaggcgtgagccactgcacctggcgattatctgtttttttttaagagatgaggtctcactatgttgcccaggctggaatacagtggctattctcaggtg

SEQ ID NO: 77140 - DNA, 601 bp, Human
tcagaaaaagttgttgattatttttattttattttatttttcgagacagagtcttgctgtgtcacccaggctggagtgcagtggtgcaatctcagctcactgtaagctctgccttccgggttcatgccattctcctgcctcagcctcccaagtagctaggactacaggcacccgccaccgcgcccaactaattttttgtatttttagtagagacagggtttcaccgtggtctcgatctcctgacctcgtcatccgcccacctcagcctcccaaagtgctgggattacaggcgtgagccacygcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagagggcggcacttaaattaacagaagtgaagtatttactttcaatggaagaaatacatactggggacggatagtcctggaaattctggtgt

SEQ ID NO: 77141 - DNA, 601 bp, Human
agggtttcaccgtggtctcgatctcctgacctcgtcatccgcccacctcagcctcccaaagtgctgggattacaggcgtgagccactgcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagaggrcggcacttaaattaacagaagtgaagtatttactttcaatggaagaaatacatactggggacggatagtcctggaaattctggtgtactattcagttaatggtttccattgagtttctttataggtaatacaggtactaacacaggatgcaatcagatagggcatattccattggggaattagatattgccagtgcagttatatagttcttttactcttgggcacttatatatggtaatgtatcaggattaaagtagagatcgatgtactagtatttatgaaaaatgtatacatattttt

SEQ ID NO: 77142 - DNA, 601 bp, Human
ggtttcaccgtggtctcgatctcctgacctcgtcatccgcccacctcagcctcccaaagtgctgggattacaggcgtgagccactgcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagagggckgcacttaaattaacagaagtgaagtatttactttcaatggaagaaatacatactggggacggatagtcctggaaattctggtgtactattcagttaatggtttccattgagtttctttataggtaatacaggtactaacacaggatgcaatcagatagggcatattccattggggaattagatattgccagtgcagttatatagttcttttactcttgggcacttatatatggtaatgtatcaggattaaagtagagatcgatgtactagtatttatgaaaaatgtatacatatttttct

SEQ ID NO: 77143 - DNA, 601 bp, Human
ctgggattacaggcgtgagccactgcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagagggcggcacttaaattaacagaagtgaagtatttactttcaatggaagaaatacatactggggacrgatagtcctggaaattctggtgtactattcagttaatggtttccattgagtttctttataggtaatacaggtactaacacaggatgcaatcagatagggcatattccattggggaattagatattgccagtgcagttatatagttcttttactcttgggcacttatatatggtaatgtatcaggattaaagtagagatcgatgtactagtatttatgaaaaatgtatacatatttttctttgataatcaggctgactttattgttatctgttaaacgactaacagattttattaagcatc

SEQ ID NO: 77144 - DNA, 601 bp, Human
actagtatttatgaaaaatgtatacatatttttctttgataatcaggctgactttattgttatctgttaaacgactaacagattttattaagcatcgtgaggtttctcagaagaatatcattgctgctattccctttctggtttgatagaacaatttattttttagtgttcctacttcttatcaatgacactgatttttattagtattagaaagggactgcacttgcttagggtttgagaagttaataaattttgccttgtatggctgttaaaagccctaagtttgttccttttttttttcttcatcttctcttttggtttcttgacagtgcattgcaatttagtttttccaatgtgaactaactgccagttcattttaatctttcttaccaccctatttttaatttaaggccctttaaccaaagagagcataaagggtcccttggcattctacatcagggtcagtgtccacaaattgtttatttctagaagtctaattctaaatttacctattaattctgtggggttttttttgtttatagttttggatcttagtgtaatcaattttaatagaggatggcttcctggatagcttacaaca

SEQ ID NO: 77145 - DNA, 601 bp, Human
tagtatttatgaaaaatgtatacatatttttctttgataatcaggctgactttattgttatctgttaaacgactaacagattttattaagcatcgtgaggtttctcagaagaatatcattgctgctattccctttctggtttgatagaacaatttattttttagtgttcctacttcttatcaatgacactgatttttattagtattagaaagggactgcacttgcttagggtttgagaagttaataaattttgccttgtatggctgttaaaagccctaagtttgttcctttttttttttttcatcttctcttttggtttcttgacagtgcattgcaatttagtttttccaatgtgaactaactgccagttcattttaatctttcttaccaccctatttttaatttaaggccctttaaccaaagagagcataaagggtcccttggcattctacatcagggtcagtgtccacaaattgtttatttctagaagtctaattctaaatttacctattaattctgtggggttttttttgtttatagttttggatcttagtgtaatcaattttaatagaggatggcttcctggatagcttacaacaac

SEQ ID NO: 77146 - DNA, 601 bp, Human
ttattgttatctgttaaacgactaacagattttattaagcatcgtgaggtttctcagaagaatatcattgctgctattccctttctggtttgatagaacaatttattttttagtgttcctacttcttatcaatgacactgatttttattagtattagaaagggactgcacttgcttagggtttgagaagttaataaattttgccttgtatggctgttaaaagccctaagtttgttcctttttttttttttcatcttctcttttggtttcttgacagtgcattgcaatttagtttttccaaygtgaactaactgccagttcattttaatctttcttaccaccctatttttaatttaaggccctttaaccaaagagagcataaagggtcccttggcattctacatcagggtcagtgtccacaaattgtttatttctagaagtctaattctaaatttacctattaattctgtggggttttttttgtttatagttttggatcttagtgtaatcaattttaatagaggatggcttcctggatagcttacaacaacctatgtccctggctcttaataaataacttttgccggtgttacggcatctgt

SEQ ID NO: 77147 - DNA, 601 bp, Human
ccggtgttacggcatctgtcttcagtagccagagttggctaactatggcccgtggaacaaattggtctgctgcctgtttttgtatagtttataagccaagagtggttttcatatttttaatgactgacaaaaaagcaaaagagtaacaatattttgtgacagatgaaaattaaatgaaatttaaatttcagagtccacaaataaaattttattgggacgtagccatgatcttttatttacatattgtctgtggctgcctttgcactaccaacagcagagttgagtagctccgacagagacygcgtgtggtgctcctgtcactttgcactgctactcagttacaattcagtaacagttataattcaacagtatttcaaatgtcataggtatccttgtacatgacctttttttttttttagtatgagtgcatacctgtctggtgagtaagaaaagtagacatctagtgttgtgcttttaagtcacagttgagcatggattattttttattgaattagatggcaaagtactgtgtctactatgcagtgacaccatagctgagttaaaggaatacaatatatgttgacattactagattaatcaa

SEQ ID NO: 77148 - DNA, 601 bp, Human
gacgttatttttcttaatgcattcagtgtaaaattacaggggaaaacagtgcttatatacaaaacttactctgctgtgaagtcatttcaacagtagatacattatttgaatcaaagtaatgtcagtcagctttatgtacttcccatgctgttaaaagtttaacacaagcactcagatccgcagtggcagtggtgtgtcctgtctgcggagagccaggccagagacaatgagcaacacctcagagaacacgagggcgtgccgcgaagccgcccacccttccgactgcggcagctgctgaccygctgttgccatgacctgcaggaaagccaatgaggagggcagttggaagaaattcttctggaactcagagaagaaggagtttttaggcaggaccggtggcagttggtttaagatcattctattctacataatattttatggctgcctgactggcatcttcatcggaatgatccaagtggtgctgctcaccatcagtgaatttaaacccacatatcagaaccgcatatcaggaccccaccaggattaacacagattactcagatccagcagactgaaattgcctttcatcctaatgatccca

SEQ ID NO: 77149 - DNA, 601 bp, Human
gtgaacccaaagaacgaggagactttaatcaagaatgaggtgagcgaaaggtctgcagattcaagcttgagtggctgggaaattgctctggattaaatgacaaaacttacagctacgaagagggcaaaccacatgttattataaagctcaagtgagttctaggcttcaaacctaagtctcccgagaatgagtccttggagacttacccagtgatgaagtataacgcatctgtgtttcctgttcagtgcactggctagcaagatgaagataaggataaaaatagaaatgtggagtattttgkactgggcacctaccttggttttcctctgcagaattatccctactatggcaaactcctgcagcccaaatacctgcagcctctgcttgctgtacagttcaccagccttaccatggacactgaaattcgcctagtgtaaagcagatggtgagaacattgggcacagtgagaaagatggttttcagggatcctttgatgtaaaaattgaagttaagagctgatcacaagcacaaatctttcccgctagccatttaataagtttaaaaaaagatacaaaagcctgttagtcttgaacaaactgtc

SEQ ID NO: 77150 - DNA, 601 bp, Human
ctggattaaatgacaaaacttacagctacgaagagggcaaaccacatgttattataaagctcaagtgagttctaggcttcaaacctaagtctcccgagaatgagtccttggagacttacccagtgatgaagtataacgcatctgtgtttcctgttcagtgcactggctagcaagatgaagataaggataaaaatagaaatgtggagtattttggactgggcacctaccttggttttcctctgcagaattatccctactatggcaaactcctgcagcccaaatacctgcagcctctgcttgytgtacagttcaccagccttaccatggacactgaaattcgcctagtgtaaagcagatggtgagaacattgggcacagtgagaaagatggttttcagggatcctttgatgtaaaaattgaagttaagagctgatcacaagcacaaatctttcccgctagccatttaataagtttaaaaaaagatacaaaagcctgttagtcttgaacaaactgtcatatgtatgggacctacacttaaagcataatctatatgctttacacttgctttctgcatttaattggttagaatgtaattaatgtaa

SEQ ID NO: 77151 - DNA, 601 bp, Human
aaacttacagctacgaagagggcaaaccacatgttattataaagctcaagtgagttctaggcttcaaacctaagtctcccgagaatgagtccttggagacttacccagtgatgaagtataacgcatctgtgtttcctgttcagtgcactggctagcaagatgaagataaggataaaaatagaaatgtggagtattttggactgggcacctaccttggttttcctctgcagaattatccctactatggcaaactcctgcagcccaaatacctgcagcctctgcttgctgtacagttcaccarccttaccatggacactgaaattcgcctagtgtaaagcagatggtgagaacattgggcacagtgagaaagatggttttcagggatcctttgatgtaaaaattgaagttaagagctgatcacaagcacaaatctttcccgctagccatttaataagtttaaaaaaagatacaaaagcctgttagtcttgaacaaactgtcatatgtatgggacctacacttaaagcataatctatatgctttacacttgctttctgcatttaattggttagaatgtaattaatgtaaactaaagtgtagcaa

SEQ ID NO: 77152 - DNA, 601 bp, Human
ctaaagtgtagcaatagcaacaaaatattctactgtaaatgacaaaagaaaaattgagccttgggatgtgctcatttttactgtaaattatgattccataagtgacttgtaagcagtgtttctggcccctaagtattgcctcctatattttatttaatgtatagtactataggtgcatactctggtcctttttcaagccatgtgttatcgtatctgttttgtactttatgtgagcaggttttgctgtccaaggtgtaaatattcaatgggaatgaaactggcatggtcttttttttttttkggggggggctctttcaaagataatggcccatcaatgagcatctttaacatattctatagtcttttcctgtggtgttaggtcttactttattattattttttctcctgggaatgggacagggatttgtcatgggggaactgccctttaaattttaagtgacactacagaaaaacacaaaaaggtgatgggttgtgttgtgcttgttttgaatgctgtcttgacatctcttcccttgtcctctagtatgttctaaagctgtgtctgagatctggatttgcccatcactttggctagtgacag

SEQ ID NO: 77153 - DNA, 601 bp, Human
taaagtgtagcaatagcaacaaaatattctactgtaaatgacaaaagaaaaattgagccttgggatgtgctcatttttactgtaaattatgattccataagtgacttgtaagcagtgtttctggcccctaagtattgcctcctatattttatttaatgtatagtactataggtgcatactctggtcctttttcaagccatgtgttatcgtatctgttttgtactttatgtgagcaggttttgctgtccaaggtgtaaatattcaatgggaatgaaactggcatggtctttttttttttttkgggggggctctttcaaagataatggcccatcaatgagcatctttaacatattctatagtcttttcctgtggtgttaggtcttactttattattattttttctcctgggaatgggacagggatttgtcatgggggaactgccctttaaattttaagtgacactacagaaaaacacaaaaaggtgatgggttgtgttgtgcttgttttgaatgctgtcttgacatctcttcccttgtcctctagtatgttctaaagctgtgtctgagatctggatttgcccatcactttggctagtgacagg

SEQ ID NO: 77154 - DNA, 601 bp, Human
aaacagaagacatctgcagcagatatattttccaagcccaacctatagttccagaagtgtttttcagatttccatgcaagtgcagaggaaatttacatatttcaaaatccattaaatagtgtagttgagcagctttctcctgacttcaattggaagtgattagtcgtcaatgtaagaagatgctaaaaggcaaatatcaacaagaatttcatagaattctataaatgctttcaaagcaatgaatatagttatttaaaattatgtttatagatttatatcagcatttggcagtacctatctrtaagattttgaatatgaaatagtaacatatcagatcatcatcaatagatgaacatttacaattaattttgatgataaggaatactaactgaatcccaattaagtgaaatattttatcctatccccccaaaaagaattctgttcttctcattagtagacctgtattacaaagaattgcactcacatatttttattatattttaaattttgtcaaaaaatttcatggaaatttgtagttatttcttgctataccttcatcatgtcctttatattacctcttggcctccaaagcatgaaatat

SEQ ID NO: 77155 - DNA, 601 bp, Human
cttttctttttactggaaaataaaatcaagttaaagtaattacatacttgatttattctatgtctctacacacatagagaataaagtgtagtttcaaatagcagtattaatactaacaatgtaatttaagatttctttgcttttctttgtatctttagtatatatatcccactagagatgtatagttcaatttctgtgtgttaaagtcacttaaaatttttctatatagaaatatcatcagtagatatacagttaggctcatttgtttcattttgcttctgatttttaaaaataattttgwttttattttataattgcctaaaaatttacatgatttcttagtcaaacctacagaacagatatttcagagaactctagcttccatctctgtcctttccactctaagtcctctctcttgtataagtaactgttttaaagtttttgggttttttttttaatacttaaaatataagaaaataaagccaggctccatggctcatgcctataatcccgggactttgggaggctgaggtgggaggatcacttgagaccaggagtttgagaccagcctgggcaacattagcgagaccattttccttac

SEQ ID NO: 77156 - DNA, 601 bp, Human
ctaagtcctctctcttgtataagtaactgttttaaagtttttgggttttttttttaatacttaaaatataagaaaataaagccaggctccatggctcatgcctataatcccgggactttgggaggctgaggtgggaggatcacttgagaccaggagtttgagaccagcctgggcaacattagcgagaccattttccttaccaaaaatttaaaaataaaaataatattttttaaaaaaacgtacacatttgtattaaacgccatacccttcataaataaggcatactatacatactttctgstcttgctttttttttgaggcggagtctcgctctgtggcccaggctggagtgcagtggcacgatcttggctcactgcaacctccgcctcctgggttcaagcaattctcctgcctcaacttctcaagtagctgggactataggcacatgccaccatgcctggctaattttttgtatttttagtagagacggggtttcaccatgttagccaggatggtctcgatgatctgaccttgtgatccacccgccttggcctcccaaagtgctgggattacaggcatgagccaccgtgcccggctgctc

SEQ ID NO: 77157 - DNA, 601 bp, Human
aaataaaaataatattttttaaaaaaacgtacacatttgtattaaacgccatacccttcataaataaggcatactatacatactttctgctcttgctttttttttgaggcggagtctcgctctgtggcccaggctggagtgcagtggcacgatcttggctcactgcaacctccgcctcctgggttcaagcaattctcctgcctcaacttctcaagtagctgggactataggcacatgccaccatgcctggctaattttttgtatttttagtagagacggggtttcaccatgttagccaggrtggtctcgatgatctgaccttgtgatccacccgccttggcctcccaaagtgctgggattacaggcatgagccaccgtgcccggctgctcttgctttttttacttaactctgtcatgaggactatgctatagcggtaaatagagacatttcttcatttattttataatactctgttttttgatataccgtaatgtattcaatcattcccccataggacgtttctagtgttttgctattaaaacgataccatgagaagccttgtaaataaaagttaaaagaattttttgtaatacaaaaata

SEQ ID NO: 77158 - DNA, 601 bp, Human
taaaaatgaaggacttgtttttgtatcaggcttagttaacttttataaaggtaatattgagaaaagaatcttaccaaactgtctttatctcattgcaaatccagattttcctgcctccttttttattgtaaaaaacacatagcccaaaatttaccatcttaaccatttttaaaggtacagttcataagtgtgtaagtatattcacattgttgtgaaacagatcttcagaggtttttcatattgcaaaactgaaacactatacccattaaataactaccccccatttccctgccaccccccgtccctggcaaccaccattctgctttttgtttctattaatttgaatactttagatacctcatataagtggagtcatacagtgtatgtccttttgagatgggcttatttcacttagcatagtgtcgtcaaggtttatccatgttgttgcatgtgacaggatttcctttttcaaggttaaataatactccatcatcatatgtatataccacattttgtttatccattcattcatccatccacggacatttgggttgcttcacctcttgactgttgtgagtactgctgctatgaacatgggcat

SEQ ID NO: 77159 - DNA, 601 bp, Human
gtacagttcataagtgtgtaagtatattcacattgttgtgaaacagatcttcagaggtttttcatattgcaaaactgaaacactatacccattaaataactaccccccatttccctgccaccccccgtccctggcaaccaccattctgctttttgtttctattaatttgaatactttagatacctcatataagtggagtcatacagtgtatgtccttttgagatgggcttatttcacttagcatagtgtcgtcaaggtttatccatgttgttgcatgtgacaggatttcctttttcaaggytaaataatactccatcatcatatgtatataccacattttgtttatccattcattcatccatccacggacatttgggttgcttcacctcttgactgttgtgagtactgctgctatgaacatgggcatgtaaatagctttttgaggccccacttgctattctttggacgtatgtccagaagtaggattgctggattatatggtaattctatgttacaattttttttaggaaccttcatatttttttccataacaattgcaccattttacattcctaccatcagtgcaaaaaggttccagttt

SEQ ID NO: 77160 - DNA, 601 bp, Human
attgcaaaactgaaacactatacccattaaataactaccccccatttccctgccaccccccgtccctggcaaccaccattctgctttttgtttctattaatttgaatactttagatacctcatataagtggagtcatacagtgtatgtccttttgagatgggcttatttcacttagcatagtgtcgtcaaggtttatccatgttgttgcatgtgacaggatttcctttttcaaggttaaataatactccatcatcatatgtatataccacattttgtttatccattcattcatccatccayggacatttgggttgcttcacctcttgactgttgtgagtactgctgctatgaacatgggcatgtaaatagctttttgaggccccacttgctattctttggacgtatgtccagaagtaggattgctggattatatggtaattctatgttacaattttttttaggaaccttcatatttttttccataacaattgcaccattttacattcctaccatcagtgcaaaaaggttccagttttgacacattgccaatccttgttattttctgtttcttgtttttttaatagtagccatcctaatgga

SEQ ID NO: 77161 - DNA, 601 bp, Human
tttgagatgggcttatttcacttagcatagtgtcgtcaaggtttatccatgttgttgcatgtgacaggatttcctttttcaaggttaaataatactccatcatcatatgtatataccacattttgtttatccattcattcatccatccacggacatttgggttgcttcacctcttgactgttgtgagtactgctgctatgaacatgggcatgtaaatagctttttgaggccccacttgctattctttggacgtatgtccagaagtaggattgctggattatatggtaattctatgttacarttttttttaggaaccttcatatttttttccataacaattgcaccattttacattcctaccatcagtgcaaaaaggttccagttttgacacattgccaatccttgttattttctgtttcttgtttttttaatagtagccatcctaatggatgtgaggtggtatctcattgtggttttcatatgtatttctctgatgattagtgatgttgagtatctttccatatgcttgttggtggtttctatataatctttggagaaatgtctattgaaatcctctccccattttttaatcagtttacaa

SEQ ID NO: 77162 - DNA, 601 bp, Human
ggttgcttcacctcttgactgttgtgagtactgctgctatgaacatgggcatgtaaatagctttttgaggccccacttgctattctttggacgtatgtccagaagtaggattgctggattatatggtaattctatgttacaattttttttaggaaccttcatatttttttccataacaattgcaccattttacattcctaccatcagtgcaaaaaggttccagttttgacacattgccaatccttgttattttctgtttcttgtttttttaatagtagccatcctaatggatgtgaggtgrtatctcattgtggttttcatatgtatttctctgatgattagtgatgttgagtatctttccatatgcttgttggtggtttctatataatctttggagaaatgtctattgaaatcctctccccattttttaatcagtttacaaatccaaattttttataacttaatatttttgctgttagctagtagcgcatatttaacatagtcctgaagagaatatcatgttcatctaaactgtgactggtaagaatatctatgacctaaatttattttgttattcttacagggctatttagaaaccaaa

SEQ ID NO: 77163 - DNA, 601 bp, Human; identical to SEQ ID NO: 34498

SEQ ID NO: 77164 - DNA, 601 bp, Human; identical to SEQ ID NO: 34499

SEQ ID NO: 77165 - DNA, 601 bp, Human; identical to SEQ ID NO: 34500

SEQ ID NO: 77166 - DNA, 601 bp, Human
aacacggtgaaaccccgtctctactaaaaatacaaaaattagctgggcgtagtggtgggcacctgtagtcccagctacttgagaggctgaggcaggagaatggtgtgaacccgggaggtggagcttgcagtgagccaagattgcgccactgcactccagtctgggcgacagagccagactctgtctcaaaaaaaaaaaaaaaaaaagaaaaaggtggaggaaaaagtgcctgcagaggagattgaggaggagtaaggagaaaagtagaaagaaaaccaggagtgtattagtccattttcaygctgctgataaagacatacccaagactgggcaatttacaaaagaaagaggtttaattggacttacagttcccgtggctagggaagcctcacaatcatggtggaaggcaaggaggagcaagttatgtcttacatggatggcagcaggcaaatagagcttgtgcagggtaactcccatttttaaaaaccatcacatctcatgagctcattcactatcacaagaacaacatgggaaagacccaccctcatgcttcagtcatctcccactgcgtccctcccaaaacatgtgggaattataggag

SEQ ID NO: 77167 - DNA, 601 bp, Human
gctagggaagcctcacaatcatggtggaaggcaaggaggagcaagttatgtcttacatggatggcagcaggcaaatagagcttgtgcagggtaactcccatttttaaaaaccatcacatctcatgagctcattcactatcacaagaacaacatgggaaagacccaccctcatgcttcagtcatctcccactgcgtccctcccaaaacatgtgggaattataggagctacaagatgagattttgtgggagacacagagccaaaccatatcaaggagtgtcaagaaagccaagggaagaagcrtttgttttttttttgtgagacggaatctcactctgtcgccaggctggagtgcagtggtgcaatctcggctcactgcaacctctgcctcccaggttcaagcgattctccttgcctcagcctcctgagtagctgggactacaggcacacatgttttaaggaaatagcaggcctggtacaggcacacacctggaatctcagcactttgggaggctgaagcaggaggattacttgagctcaggaatttcagaccaccttgggcaacatagtgagaccttgtacctacaaaaaaatttttttaat

SEQ ID NO: 77168 - DNA, 601 bp, Human
cactttgggaggctgaagcaggaggattacttgagctcaggaatttcagaccaccttgggcaacatagtgagaccttgtacctacaaaaaaatttttttaattagctgggcatggtgggtgatgtgcgcctgtagacctactcaggaagctgaggcaggagaatcatttgagcccaggagtttaaggctacagtaagctgtgattataccactgcactccaacgtgggcaagaacaagaccctgtctttaaaaaataaatagccagctagggggtggcgggcaagatggctggataggaasagatcctgtctgcagctcccagtgagatccatgcagaaggtggataacttctgcatttccagctgaggtacctggctcatctcattgggactggtcagacagtgggtgcagcccatggagggtgacccgaagcagggtggggcattgcctcaccggggtagtgcaaggggtcggggaactccctcccctagccaagggaagccatgagggactgtgctgtgaggaacggtgcattccagcccagatactacgcttttcccatggtcttcacaacccacagaccaggagattccctcgggt

SEQ ID NO: 77169 - DNA, 601 bp, Human
acaagaccctgtctttaaaaaataaatagccagctagggggtggcgggcaagatggctggataggaagagatcctgtctgcagctcccagtgagatccatgcagaaggtggataacttctgcatttccagctgaggtacctggctcatctcattgggactggtcagacagtgggtgcagcccatggagggtgacccgaagcagggtggggcattgcctcaccggggtagtgcaaggggtcggggaactccctcccctagccaagggaagccatgagggactgtgctgtgaggaacggtgcmttccagcccagatactacgcttttcccatggtcttcacaacccacagaccaggagattccctcgggtgcctacaccaccagggccttgggtttcaagcacaaaactgggcggccatttgggcagacaccaagctagctagactagttttttttcatactccagtggtgcctcgaatgccagtgagacagaaccttttaatcccttggaaagggggctgaaaccagggagctaagtggtctagctcagcagatcccacctccagagagcccagaaagctaagatccactggcttgaaattc

SEQ ID NO: 77170 - DNA, 601 bp, Human
ctgcagctcccagtgagatccatgcagaaggtggataacttctgcatttccagctgaggtacctggctcatctcattgggactggtcagacagtgggtgcagcccatggagggtgacccgaagcagggtggggcattgcctcaccggggtagtgcaaggggtcggggaactccctcccctagccaagggaagccatgagggactgtgctgtgaggaacggtgcattccagcccagatactacgcttttcccatggtcttcacaacccacagaccaggagattccctcgggtgcctacaccrccagggccttgggtttcaagcacaaaactgggcggccatttgggcagacaccaagctagctagactagttttttttcatactccagtggtgcctcgaatgccagtgagacagaaccttttaatcccttggaaagggggctgaaaccagggagctaagtggtctagctcagcagatcccacctccagagagcccagaaagctaagatccactggcttgaaattctggctgccagcacagctgtctgaagttgacatgggatgcttgagtttggtgtgtgttggggagttgggggttgggga

SEQ ID NO: 77171 - DNA, 601 bp, Human
agatccactggcttgaaattctggctgccagcacagctgtctgaagttgacatgggatgcttgagtttggtgtgtgttggggagttgggggttggggaccaccattactgaggcttgagtaggcagttttcccctcacagtgtaaacaaagccatcaggaagttcgaactggacagaacccaccgtagctcagcaaagccactgtagccagactgcctctctagatttcttctctctgggcagggcatctctgaaagaaaggcccagcagtcccggtcaggggcttatagataaaactctmatctctctgggacagaaaacttgggggtaggggcggctgtgggcgcagcttcagcagacttaaacgttcctgtctgctggctctgaagagagcagcggatctcccagcacagcgctcgaggtctgctaagggacagactgcctcctcaagtgggtccttgacccccatgcctcctgatggggagatacctcccagcagggatcaacagacacctcatacaggagagctccagctgacatctggcaggtgctcctctgggatgaagcttccagaggaaggaacaggcagcaatgtttgctg

SEQ ID NO: 77172 - DNA, 601 bp, Human
cccagcacagcgctcgaggtctgctaagggacagactgcctcctcaagtgggtccttgacccccatgcctcctgatggggagatacctcccagcagggatcaacagacacctcatacaggagagctccagctgacatctggcaggtgctcctctgggatgaagcttccagaggaaggaacaggcagcaatgtttgctgttctgcagcccctgctgttgatacccaggtaaacagggtctggagtggacctccagcaaactccagcagacctgcagcagagaggcctgactgttagaaagaraactaacaaacagaaaggaatagcatcaacatcaacaaaaaggatgtccacacaaaaaccccatccaaaagtcaccaacatcaaagaccaaaggtagataaatccacgaagatgaggaaaaaccagtgcaaaaaggctgaaaattccaaaaaccagaacacctcttctcctccaaaggatcacaactcctcgccagcaagggaacaaaactggacggagaatgagtttgacgaagtaggcttcagaaagtgggtaataacaaactcctccaagctaaaggagcatgttccaacccaacgc

SEQ ID NO: 77173 - DNA, 601 bp, Human
cacctcatacaggagagctccagctgacatctggcaggtgctcctctgggatgaagcttccagaggaaggaacaggcagcaatgtttgctgttctgcagcccctgctgttgatacccaggtaaacagggtctggagtggacctccagcaaactccagcagacctgcagcagagaggcctgactgttagaaagagaactaacaaacagaaaggaatagcatcaacatcaacaaaaaggatgtccacacaaaaaccccatccaaaagtcaccaacatcaaagaccaaaggtagataaatccaygaagatgaggaaaaaccagtgcaaaaaggctgaaaattccaaaaaccagaacacctcttctcctccaaaggatcacaactcctcgccagcaagggaacaaaactggacggagaatgagtttgacgaagtaggcttcagaaagtgggtaataacaaactcctccaagctaaaggagcatgttccaacccaacgcaagaaagctaagaaccttgaaaaaaggtaagagaaattgctaactagaataaccagtttagagaagaacataaatgacctgatggagctgaaaaacacagcatgaga

SEQ ID NO: 77174 - DNA, 601 bp, Human
agagatagagacaccaaaaacccttcaaaaaaccagtgaatccaggagctggtttttttaaaagattcacaaaatacatagaccactagccagactaataaaaaagaaaagagaggagaatcaaatagacaacaatgaaaaatgataaaggggatgtcaccactgatcccacagaaatacaaagtaccatcagagaataatataaacacctctacgcaaataaactagaagatctagaagaaatggataaattcctggacacacacaccctcccaagactaaaccaggaagaagttgaatycctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaactattccaaacaataggaaaagaaggactcctcctcaactcgttttatgaggccagcatcatcctgataccaaaacctggcagagacacacaaaaaaaagaaaatttcagaccaaaatccttgatgaacatcgatgcagaaatcctcaataa

SEQ ID NO: 77175 - DNA, 601 bp, Human
ggggatgtcaccactgatcccacagaaatacaaagtaccatcagagaataatataaacacctctacgcaaataaactagaagatctagaagaaatggataaattcctggacacacacaccctcccaagactaaaccaggaagaagttgaatccctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaastattccaaacaataggaaaagaaggactcctcctcaactcgttttatgaggccagcatcatcctgataccaaaacctggcagagacacacaaaaaaaagaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatac

SEQ ID NO: 77176 - DNA, 601 bp, Human
agaagaaatggataaattcctggacacacacaccctcccaagactaaaccaggaagaagttgaatccctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaactattccaaacaataggaaaagaaggactcctcctcaactcgttttatgaggccagcatcatcctgataccaaaacctggcagagasacacaaaaaaaagaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatacaaaaaccaaatgattatctcagtagttgcagaaaagcccttcaataaaattcaacaccgcctcatgctaaaaactctcaccttaaa

SEQ ID NO: 77177 - DNA, 601 bp, Human
aatggataaattcctggacacacacaccctcccaagactaaaccaggaagaagttgaatccctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaactattccaaacaataggaaaagaaggactcctcctcaactcgttttatgaggccagcatcatcctgataccaaaacctggcagagacacacamaaaaaagaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatacaaaaaccaaatgattatctcagtagttgcagaaaagcccttcaataaaattcaacaccgcctcatgctaaaaactctcaccttaaactaggt

SEQ ID NO: 77178 - DNA, 601 bp, Human
gaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatacaaaaaccaaatgattatctcagtagttgcagaaaagcccttcaataaaattcaacaccgcctcatgctaaaaactctcaccttaaactaggtattggcrgaacgtatctcaaaataaaaagagctatttatgacaaacccacagccaatatcatactgaatgggcagtagctggaagcattccctttgaaaaccagcacaagacaaggatgctgtctctcaccactcctattcaacatagtattggaagctctggccagggcaatcaggcaagagaaagaaataaagggtattcaaataggaagagaggaagtcaagttgtctctgtttgcagatgacatgattgtatatttagaaaaccccataatctcagcccaaaatctccttaagctgataagca

SEQ ID NO: 77179 - DNA, 601 bp, Human
ctccttaagctgataagcaacttgagcaaagtctcaggatacaaaatcaatgtacaaaaatcacaagcattcttacataccaataatagacaaacagccaaatcatgagtgaactcccattcacagttgctacaaagagaataaaatacctaggaatacaacttacaagggatgtgaaggacctcttcaaggagaactacaaaccactgctcaaggaaataagagaggacacaaagaaatggaaaaacattccatgctcgtggataggaataatcaatatcatgaaaatggccgtactgcrcaaagtaattaatggaatcaatgatatccccatcaagctaccattgactttcttcacagaattagaaaaaaaacttctttaaatttcatatggaaccaaaaaagagcctgtatagccaagataatcctaagcaaaaagaacaaagctggaggcatcatgctgcctgacttcaaactatactacaaggctgcggtaaccaaaacagcatggtactggtaccaaaacagatatatagaccaatgtaacagaactgaggccttagaaataacaccaaacatctacaaccatctgatctttgac

SEQ ID NO: 77180 - DNA, 601 bp, Human
tcaaggaaataagagaggacacaaagaaatggaaaaacattccatgctcgtggataggaataatcaatatcatgaaaatggccgtactgcgcaaagtaattaatggaatcaatgatatccccatcaagctaccattgactttcttcacagaattagaaaaaaaacttctttaaatttcatatggaaccaaaaaagagcctgtatagccaagataatcctaagcaaaaagaacaaagctggaggcatcatgctgcctgacttcaaactatactacaaggctgcggtaaccaaaacagcatgrtactggtaccaaaacagatatatagaccaatgtaacagaactgaggccttagaaataacaccaaacatctacaaccatctgatctttgacaaacctgacaaaagcaatggggaaaggattcccgatttaataaatggtgctgggaaaactggcaagccatatgcagaaaactgaaactggaccctgtctttataccttatacaaaaattaactcaagatggattaaagacttaaacgtaagacctaaaaccataaaaaccctagaagaaaacctaggcaataccattcaggacataggca

SEQ ID NO: 77181 - DNA, 601 bp, Human
aagctcatcatcactggtcattagagaaatgcaaatcgaaaccacaatgagattctatctcacgccagttagattggcgatcatttaaaagtcaggaaacagcagatgctggagaggatgtggagaaataggaacacttttacactgttggtgagagtgtaaattagttcaaccattgtggaagacagtgtggcgattcctccaggatctagaaccggaaataccatttgatccagcagtcccattactgtgtatatatccaatagattataaatcattctactataaagacacatgcacrtgtatgttttttgtagcactattcatattagcagacttggagccaacccagatgcccatcaatgatagactggataaagaaaatgtggcacatatacaccatgggataatatgcagccataaaaaaggatgagttcatgtcctttgcagggacatggatgaagctggaaaccatcattctcagcagactagcacaagaacagaaaatcaaacaccacatgttctcactcataagtgagagctgaacaatgaaaacacatggacacagagaggggaatatcacacactggggcctattggg

SEQ ID NO: 77182 - DNA, 601 bp, Human
ctctcatttataaaatgggggtgttaatatttgtataacagacttgtaatataacatggtaactcactagataacgtctgagataaatcatattagtcattactgttagtatctgagcagctagtttcctcagagttaactgtgtttattttggcatctagctgcttctagtatgactctgagactgcttagagtcacctctggcatctgcctccttaagtaaacagattttcactgaagtcttgcctttgacactggcccaatggacagtatcaggtgcagatctgcttttatctacctraaacacataattttcttttacattttatcttgtccacatatagaagaccgtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagttgcacgatcatagctcacttcagcctcaaac

SEQ ID NO: 77183 - DNA, 601 bp, Human
ataacatggtaactcactagataacgtctgagataaatcatattagtcattactgttagtatctgagcagctagtttcctcagagttaactgtgtttattttggcatctagctgcttctagtatgactctgagactgcttagagtcacctctggcatctgcctccttaagtaaacagattttcactgaagtcttgcctttgacactggcccaatggacagtatcaggtgcagatctgcttttatctacctgaaacacataattttcttttacattttatcttgtccacatatagaagaccrtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagttgcacgatcatagctcacttcagcctcaaactcctgggctcagatgatcttcccacctcagcctctcagtagctgggacta

SEQ ID NO: 77184 - DNA, 601 bp, Human
tatcaggtgcagatctgcttttatctacctgaaacacataattttcttttacattttatcttgtccacatatagaagaccgtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagtkgcacgatcatagctcacttcagcctcaaactcctgggctcagatgatcttcccacctcagcctctcagtagctgggactaaaggcgtgcactaccacaccagactaagtttttaaaaaattttttgtagagatggggtcttactttgttgcccagactggtcttgaactcctgtcctcaagccatcctcccacctcagcctcccaaaatgttggcattgtaggtgtgagccattgtgcttagcctaattttactttcaacagaatctagtgtagagatatacagctgattgagtatgctt

SEQ ID NO: 77185 - DNA, 601 bp, Human
tatctacctgaaacacataattttcttttacattttatcttgtccacatatagaagaccgtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagttgcacgatcatagctcacttcrgcctcaaactcctgggctcagatgatcttcccacctcagcctctcagtagctgggactaaaggcgtgcactaccacaccagactaagtttttaaaaaattttttgtagagatggggtcttactttgttgcccagactggtcttgaactcctgtcctcaagccatcctcccacctcagcctcccaaaatgttggcattgtaggtgtgagccattgtgcttagcctaattttactttcaacagaatctagtgtagagatatacagctgattgagtatgcttttggcttaaatttttgtccaa

SEQ ID NO: 77186 - DNA, 601 bp, Human
taattgtacttgttttttttgttattgttgttgttgttttagcgatggggtctcactctcttgcctaggctggagtgcagttgcacgatcatagctcacttcagcctcaaactcctgggctcagatgatcttcccacctcagcctctcagtagctgggactaaaggcgtgcactaccacaccagactaagtttttaaaaaattttttgtagagatggggtcttactttgttgcccagactggtcttgaactcctgtcctcaagccatcctcccacctcagcctcccaaaatgttggcattrtaggtgtgagccattgtgcttagcctaattttactttcaacagaatctagtgtagagatatacagctgattgagtatgcttttggcttaaatttttgtccaaacctatgctaaattgttttctctttctcttctagcaatggattaaactgcttctttaaatttcttgcctggatttataccggttcagcaagtatgttctcagaagctatacactcattatctgatacttgtaatcaggtgaggactaaagctttttttataagtcaattttaaagtaatagttgtaggctttaatcta

SEQ ID NO: 77187 - DNA, 601 bp, Human
tcttgtaagcttatcgaggaaagttgaaatacagaaatatttgtccatatggcaaggagatatgtatgatgttattagtttcaatattagtttttatttcaaacattgaagacagtgtttaagtgttcattctctatgctattcaggcatttaaaaagaatgtagtagatatctgtgtactgacctggaatgataaccatgataaattgagtaaaaaatcaagttgcaaaatactatgttcagaacttctgctttcacccatgacagactaacagggattgagtttaatcttttgccataracaactaaaagctagacagtatattggataatagcagcataagaccatgatctctgagagataagaaacaaattatttgaactctctgatctctctggctttttgcttgaacacatatttgggatagtggagcaggatgggaaataacagtctcattgagttgagaagacagaaatcagtgttcagggcgtctgaggtggctagaacttacaaggaagagttccacagaggaaggagctacaaggacaaaaagctatagaagtctacatagggatttccttgaattgaatgtttgctgaa

SEQ ID NO: 77188 - DNA, 601 bp, Human
atgataaccatgataaattgagtaaaaaatcaagttgcaaaatactatgttcagaacttctgctttcacccatgacagactaacagggattgagtttaatcttttgccataaacaactaaaagctagacagtatattggataatagcagcataagaccatgatctctgagagataagaaacaaattatttgaactctctgatctctctggctttttgcttgaacacatatttgggatagtggagcaggatgggaaataacagtctcattgagttgagaagacagaaatcagtgttcagggygtctgaggtggctagaacttacaaggaagagttccacagaggaaggagctacaaggacaaaaagctatagaagtctacatagggatttccttgaattgaatgtttgctgaatgttaagttacacatgtgtaagatgtgagcatcaatctgggcagagaaccagcagggagcagtaactgactaattcccactgctcacacaaagctaggttacattcaggttctgactagctgacgtaagagagttctcattgattatcgaggccaatggaaggctcaccttaggagtagggctaaatta

SEQ ID NO: 77189 - DNA, 601 bp, Human
ttcataaataggacacagaaacaatatcataaaataagatttacaaattcaacttcatcaaaattaaaaacttttgctcattgaaagacatccttaaggaaataaatacgcatagattgggagaaaatagtcacaaagcattctgacaagggactggtatccaggattaagaaattccacgattcagtaataaaatgagaacccagttttttccccccaaggataaagatttgggcaggtacttcacaaataaggaaacatgaatggtggccagtggacacctgaaaatgtgctaacaccrttaatgatcaggaaatgtatattaataccacaagacatctctgcatatccactataatggctacaagtaaaaacctgacagccaaatgttggtgaagatgtggagcagccagatctcccagtcattgctggtgtattactaaaatggtacaaccactctggaaaatatttggcagcctcctataaacatatacttatcctgtgacccaccaattccacttctaagtatttacccaagggaagtgggaatgaatggtcccaaaagatttgtataagaatgttggctgggcgcggtggctca

SEQ ID NO: 77190 - DNA, 601 bp, Human
ggcccatgtaatcccagctactcgggaggctaaggcaggagaatcgcttgaacccgggaggcgggggttacagtgagccgagatccgagattgcaccactgcactccagcctggatgacaagagtgactcggtctccaaaaaaaaaaaaaaaaaaaaaaaggaatgttatagcagctttacttataatggctgaaaaaattggaatcaacccaaatgtttatcagcagtacagcagataaacaaattgtggtatactcatacaatggaatattatctggcaataaaagggaatgaagtacytttctgactggcaacatagatgtatctccagcaaggaactttaatttttaatagtttaaaaaaattgggaaaaatggttgcgtctgatgtcggggaggaaagaggcacagggagctttttgggaatgatggaaaggttctgtgtcttcataggaatatatgtttcaagggtatgtgtatttgttaacaaccagaactgtacattctgggccaggtacggtggctcatgcctgtaattccagcacattgggaggccgaggtgggcagatcactggaggtcaggagttcgaggccagcctgg

SEQ ID NO: 77191 - DNA, 601 bp, Human
ggaatattatctggcaataaaagggaatgaagtacctttctgactggcaacatagatgtatctccagcaaggaactttaatttttaatagtttaaaaaaattgggaaaaatggttgcgtctgatgtcggggaggaaagaggcacagggagctttttgggaatgatggaaaggttctgtgtcttcataggaatatatgtttcaagggtatgtgtatttgttaacaaccagaactgtacattctgggccaggtacggtggctcatgcctgtaattccagcacattgggaggccgaggtgggcrgatcactggaggtcaggagttcgaggccagcctggccaatacggtgaaacccgcatctctactaaaaatacaaaaacattagctgagcgtggtggtacatgcctgtaatcccagctactcaggagatggagacaggagaatcacttgaacccgggaggcagaggttgcagtgagtcaagatggcaccactgtactccagcctgggcgacagaactagacatctcaaaacaaaaacaaaaacaaaactgtacattcaggatttgtgcatttcattgtatgtgaattttacctcaaaaaaat

SEQ ID NO: 77192 - DNA, 601 bp, Human
tataattgttaaagcttaatgatggatgatttgagtttttaaaaatgttctatcagggccgggcatggtggctcatgcctgtaatcccagcactttgggaggccgaagcaggcagatcacctgaggtcaggagttcgagaccagcctgaccaacatggcaaaaccccgtctcttagagttttcaaaaagacttcagttaaaaatatttcaactggacctttctgaatagatggaaattgtatttcagaaagttgtttctttcgagacctataatatttttaaaattttaattcattgtaayatttttatgccatatgttttccctcacttcttgagagacttaagtacctccaacttttaaattagacctgtgtctctaattataatgtagttttttatttatttatttacttattttttgagacagagtctcactgtcttgcccaggctggaatgcagtggcacaatctcggcttactgcaagctccatctcccaggttcacgccattctcctgcctcagcttcccgaatagctgggactacaggcgcccgccaccacgcccggctagttttttgtatttgcagtacagacagggtttca

SEQ ID NO: 77193 - DNA, 601 bp, Human
atagagatttatgttgtaaatgtgtagaaaaaggtctggaaggatacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacytttaatgtacaggtgtgtattagtccattttcacactgctgataaaaacatacccaagactgggcaatttacaaaaaaaagaggtttaattgtgactagggcaggctcacaatcatggtggaaggtgaaaggcatgtctcacatggcagcagacaagagaagagggcttgtgcagggaaactcccctttttaaaaccatcagatcttgtgagacttattcactatcacgagaacagccgaggaaagacttgcctccatgattcagttacctcccactaggtccctcccacaacatgtggg

SEQ ID NO: 77194 - DNA, 601 bp, Human
gtagaaaaaggtctggaaggatacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacctttaatgtacaggtgtgtattaktccattttcacactgctgataaaaacatacccaagactgggcaatttacaaaaaaaagaggtttaattgtgactagggcaggctcacaatcatggtggaaggtgaaaggcatgtctcacatggcagcagacaagagaagagggcttgtgcagggaaactcccctttttaaaaccatcagatcttgtgagacttattcactatcacgagaacagccgaggaaagacttgcctccatgattcagttacctcccactaggtccctcccacaacatgtgggaattcaagatgagatttgggtgg

SEQ ID NO: 77195 - DNA, 601 bp, Human
atacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacctttaatgtacaggtgtgtattagtccattttcacactgctgayaaaaacatacccaagactgggcaatttacaaaaaaaagaggtttaattgtgactagggcaggctcacaatcatggtggaaggtgaaaggcatgtctcacatggcagcagacaagagaagagggcttgtgcagggaaactcccctttttaaaaccatcagatcttgtgagacttattcactatcacgagaacagccgaggaaagacttgcctccatgattcagttacctcccactaggtccctcccacaacatgtgggaattcaagatgagatttgggtggggacacagccaaaccatatc

SEQ ID NO: 77196 - DNA, 601 bp, Human
ctcccacaacatgtgggaattcaagatgagatttgggtggggacacagccaaaccatatcttcccgccccagcccctcccgaatctcatgtcctcacatttcaaaaccagtcatgccttcccaacagtcccccaaagtcttaactcatttcagcattaactcaaaagtccatccaaggtgtcatctaagacaaggcaagtcccttctgcctatgaacctgtaaaatcaaaagcaggttagttatttcctggatacaatgagggtacaggcattgggtaaatacagacattgggtaaatacmatgtctccatttggcgacattgggtaaatgtctccaaaagggagacattggccaaaacaaaggggctacaggccccatgcaagtccagaatccagcggggcagtcaattcgtaaagctccaaaatgatctcctttcgctccatgtctcacctccaggtcacgctgatgcaaaaggtgggctcccacagccatgggcagctccacctctttagctctgcaggatatagcccacttttggctgctttcaggggctggcattgagtgtctgtggcttttccaggtgcactgtgcaagctgtca

SEQ ID NO: 77197 - DNA, 601 bp, Human
gtcccttctgcctatgaacctgtaaaatcaaaagcaggttagttatttcctggatacaatgagggtacaggcattgggtaaatacagacattgggtaaatacaatgtctccatttggcgacattgggtaaatgtctccaaaagggagacattggccaaaacaaaggggctacaggccccatgcaagtccagaatccagcggggcagtcaattcgtaaagctccaaaatgatctcctttcgctccatgtctcacctccaggtcacgctgatgcaaaaggtgggctcccacagccatgggcarctccacctctttagctctgcaggatatagcccacttttggctgctttcaggggctggcattgagtgtctgtggcttttccaggtgcactgtgcaagctgtcagtggatctatcattctgggatatggagggcaatggccgccctctgctcacagctccactaggtggtgtcccagtaggttttctgtgtgggggctcccaccccacatttcccttaagcactgccctagcagaggttgtccatgagagccccgcctgtgcagcaaacttctacctgggcatccaggtgtttcccatacat

SEQ ID NO: 77198 - DNA, 601 bp, Human
ctctgctcacagctccactaggtggtgtcccagtaggttttctgtgtgggggctcccaccccacatttcccttaagcactgccctagcagaggttgtccatgagagccccgcctgtgcagcaaacttctacctgggcatccaggtgtttcccatacatcctctgaaatctaggcagagatttccaaacctcagttcttgacttctgtgcacccacaggcccaacaccacgtggaagctgccaaggcttggggcttccacctactgaagcaatagctggagctgtaccttggccccttttartcacagctggagcagctgggatgcaaggcactaagctcccagactgcacacagcagagggaccctaggcccagcccacaaaaccacttttcttcctaaacctccaggcctgtgattcaaggggctgccacaaaggtctttgacatgccctagagacattttcccccttttcttggtgattaacattcagttcctcattacttatgcaaatttctgcagctggcttgaatttctcctcagaaaatggaattttcttttctattgcattgtaaggctgcaaatttttgaaacttttatgctc

SEQ ID NO: 77199 - DNA, 601 bp, Human
cggggctgggcacagtggctcatgcctgtaatcccagcactttgggaggctgaggcgggcggatcacgaggtgaagaaatcgagaccatcctggccaacatggtgaaaccccatctctactaaaaatacaaaaattagctgggtgtggtggcacttgcctgtagtcccagctactcgggaggctgaggcaggataatcgcttgaacctgggaagcagaggttacagtaagccaagatcgtgccactgcattccagcctggcgacagagtgagactttgtctcaaaaaaaaaaaaaaaaaaactgaattcctttaatagcacccaaatcacctcttgaatgctttgctgcttagaaatttctccagccagacactctaaatcatctctctcaagttcaaagttcacaaatctctagggcaggggcaaaatgctaccagtctctttgcttaaaacataacaagagtcacctttgccccagtttccaacaagttcctcatttccatctgagaccacctcagcctggactttattgtccgtattgctgtcagcattttgggcaaagccattcaacaagtctctaggaaattccaaactttctcac

SEQ ID NO: 77200 - DNA, 601 bp, Human
tctaggaaattccaaactttctcacattttcctatctttttctgagccctccaaactgttccaacccctgcctgttacccagttccaaagttgcttccacattttcgggtatctagagcagcaccccactctactggtaccaatttactgtattattctgttttcatgctgctgataaagacatgcccaagactgggcaatttacagaaaaaggaggtttaatggacttacaatttcacatggctagggaagcctcacaatcatggcagaaggtgaaaggcacgtctcacatggtggcaasacaagagaagagagcttgtgcagggaaactcccctttttaaaacaatcagatctcataagacgtattcactagcacaagaacagcatgggaaagacctgccctgatgattcagttacctcccaccagatcccacaacacttgggaattcaaaatgagatttgggtggggacacagccaaaccatatcagggtgtaaaagagttatatcttcctttgaatttcctgtcattctcttagtttaattccctgaaaaatcatgtatattttaggtggtttgctcccttttcccatggaatccag

SEQ ID NO: 77201 - DNA, 601 bp, Human
cacattttcctatctttttctgagccctccaaactgttccaacccctgcctgttacccagttccaaagttgcttccacattttcgggtatctagagcagcaccccactctactggtaccaatttactgtattattctgttttcatgctgctgataaagacatgcccaagactgggcaatttacagaaaaaggaggtttaatggacttacaatttcacatggctagggaagcctcacaatcatggcagaaggtgaaaggcacgtctcacatggtggcaagacaagagaagagagcttgtgcrgggaaactcccctttttaaaacaatcagatctcataagacgtattcactagcacaagaacagcatgggaaagacctgccctgatgattcagttacctcccaccagatcccacaacacttgggaattcaaaatgagatttgggtggggacacagccaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattct

SEQ ID NO: 77202 - DNA, 601 bp, Human
ggtatctagagcagcaccccactctactggtaccaatttactgtattattctgttttcatgctgctgataaagacatgcccaagactgggcaatttacagaaaaaggaggtttaatggacttacaatttcacatggctagggaagcctcacaatcatggcagaaggtgaaaggcacgtctcacatggtggcaagacaagagaagagagcttgtgcagggaaactcccctttttaaaacaatcagatctcataagacgtattcactagcacaagaacagcatgggaaagacctgccctgatkattcagttacctcccaccagatcccacaacacttgggaattcaaaatgagatttgggtggggacacagccaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattctgtgtatttagggtagggtttccaatattaagacctaaaaatatatttgtattaagtattttcaagtttctttaatctctattttt

SEQ ID NO: 77203 - DNA, 601 bp, Human
aaagacatgcccaagactgggcaatttacagaaaaaggaggtttaatggacttacaatttcacatggctagggaagcctcacaatcatggcagaaggtgaaaggcacgtctcacatggtggcaagacaagagaagagagcttgtgcagggaaactcccctttttaaaacaatcagatctcataagacgtattcactagcacaagaacagcatgggaaagacctgccctgatgattcagttacctcccaccagatcccacaacacttgggaattcaaaatgagatttgggtggggacacagycaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattctgtgtatttagggtagggtttccaatattaagacctaaaaatatatttgtattaagtattttcaagtttctttaatctctattttttattagaaaaaatgtgtctattaaatttcttgtaacctaagggaaacctcatctgtgaagaagtcatta

SEQ ID NO: 77204 - DNA, 601 bp, Human
gattcacatcaaattaggatggaaaggacttactagggacaagcatactactattgagaagttccagtggataactctttaacaaagggcaaaactttaaaaaccacctaagtggaaatgaaagaaagaaggaagaaatgatgaaggcaagtgagacagaggagaggcagtcagaaaggaaggaaagaaaagaatatgatatataattcctgtgcatggttttgcagttttaatagaaatgtgtgtgcccatacacaatatatatatattgtttaaagttgttattatcttttacttgtamagctatacaagttattcttcctgtaaaaagtcaaatattagactaccttaattctgcctctcttcagagatacaaacatagttacttgcatgttcttttaaaccttttctgtgctttacattatatgtagtttataaaaactacaaagcgtaagttctgtactgtacatactgttcctaacttgcttttttctcttcttccacttaatggtatgtctaggagctttatccatgtcagtatagaaagctctactctaaccctatttttttaacctactgtagaagtaatttatggtttatc

SEQ ID NO: 77205 - DNA, 601 bp, Human
atgaaggcaagtgagacagaggagaggcagtcagaaaggaaggaaagaaaagaatatgatatataattcctgtgcatggttttgcagttttaatagaaatgtgtgtgcccatacacaatatatatatattgtttaaagttgttattatcttttacttgtacagctatacaagttattcttcctgtaaaaagtcaaatattagactaccttaattctgcctctcttcagagatacaaacatagttacttgcatgttcttttaaaccttttctgtgctttacattatatgtagtttataaaaactacaaagcgtaagttctgtactgtacatactgttcctaacttgcttttttctcttcttccacttaatggtatgtctaggagctttatccatgtcagtatagaaagctctactctaaccctatttttttaacctactgtagaagtaatttatggtttatcatttattttgtcattcccaattgatggattttttttaggttgctttcatgtttctcatctttataaacaatggtgttttgaacccctttgagttcatctttattttttaaggtaagtactagaaaccagaattgctgggt

SEQ ID NO: 77206 - DNA, 601 bp, Human
gtgagacagaggagaggcagtcagaaaggaaggaaagaaaagaatatgatatataattcctgtgcatggttttgcagttttaatagaaatgtgtgtgcccatacacaatatatatatattgtttaaagttgttattatcttttacttgtacagctatacaagttattcttcctgtaaaaagtcaaatattagactaccttaattctgcctctcttcagagatacaaacatagttacttgcatgttcttttaaaccttttctgtgctttacattatatgtagtttataaaaactacaaagcrtaagttctgtactgtacatactgttcctaacttgcttttttctcttcttccacttaatggtatgtctaggagctttatccatgtcagtatagaaagctctactctaaccctatttttttaacctactgtagaagtaatttatggtttatcatttattttgtcattcccaattgatggattttttttaggttgctttcatgtttctcatctttataaacaatggtgttttgaacccctttgagttcatctttattttttaaggtaagtactagaaaccagaattgctgggtcattggacat

SEQ ID NO: 77207 - DNA, 601 bp, Human; identical to SEQ ID NO: 34501

SEQ ID NO: 77208 - DNA, 601 bp, Human; identical to SEQ ID NO: 34502

SEQ ID NO: 77209 - DNA, 601 bp, Human; identical to SEQ ID NO: 34503

SEQ ID NO: 77210 - DNA, 601 bp, Human; identical to SEQ ID NO: 34504

SEQ ID NO: 77211 - DNA, 601 bp, Human; identical to SEQ ID NO: 34505

SEQ ID NO: 77212 - DNA, 601 bp, Human; identical to SEQ ID NO: 34506

SEQ ID NO: 77213 - DNA, 601 bp, Human; identical to SEQ ID NO: 34507

SEQ ID NO: 77214 - DNA, 601 bp, Human; identical to SEQ ID NO: 34508

SEQ ID NO: 77215 - DNA, 601 bp, Human; identical to SEQ ID NO: 34509

SEQ ID NO: 77216 - DNA, 601 bp, Human; identical to SEQ ID NO: 34510

SEQ ID NO: 77217 - DNA, 601 bp, Human; identical to SEQ ID NO: 34511

SEQ ID NO: 77218 - DNA, 601 bp, Human; identical to SEQ ID NO: 34512

SEQ ID NO: 77219 - DNA, 601 bp, Human; identical to SEQ ID NO: 34513

SEQ ID NO: 77220 - DNA, 601 bp, Human; identical to SEQ ID NO: 34514

SEQ ID NO: 77221 - DNA, 601 bp, Human; identical to SEQ ID NO: 34515

SEQ ID NO: 77222 - DNA, 601 bp, Human; identical to SEQ ID NO: 34516

SEQ ID NO: 77223 - DNA, 601 bp, Human; identical to SEQ ID NO: 34517

SEQ ID NO: 77224 - DNA, 601 bp, Human; identical to SEQ ID NO: 34518

SEQ ID NO: 77225 - DNA, 601 bp, Human; identical to SEQ ID NO: 34519

SEQ ID NO: 77226 - DNA, 601 bp, Human; identical to SEQ ID NO: 34520

SEQ ID NO: 77227 - DNA, 601 bp, Human; identical to SEQ ID NO: 34521

SEQ ID NO: 77228 - DNA, 601 bp, Human; identical to SEQ ID NO: 34522

SEQ ID NO: 77229 - DNA, 601 bp, Human; identical to SEQ ID NO: 34523

SEQ ID NO: 77230 - DNA, 601 bp, Human; identical to SEQ ID NO: 34524

SEQ ID NO: 77231 - DNA, 601 bp, Human; identical to SEQ ID NO: 34525

SEQ ID NO: 77232 - DNA, 601 bp, Human; identical to SEQ ID NO: 34526

SEQ ID NO: 77233 - DNA, 601 bp, Human; identical to SEQ ID NO: 34527

SEQ ID NO: 77234 - DNA, 601 bp, Human; identical to SEQ ID NO: 34528

SEQ ID NO: 77235 - DNA, 601 bp, Human; identical to SEQ ID NO: 34529

SEQ ID NO: 77236 - DNA, 601 bp, Human; identical to SEQ ID NO: 34530

SEQ ID NO: 77237 - DNA, 601 bp, Human; identical to SEQ ID NO: 34531

SEQ ID NO: 77238 - DNA, 601 bp, Human; identical to SEQ ID NO: 34532

SEQ ID NO: 77239 - DNA, 601 bp, Human; identical to SEQ ID NO: 34533

SEQ ID NO: 77240 - DNA, 601 bp, Human; identical to SEQ ID NO: 34534

SEQ ID NO: 77241 - DNA, 601 bp, Human; identical to SEQ ID NO: 34535

SEQ ID NO: 77242 - DNA, 601 bp, Human; identical to SEQ ID NO: 34536

SEQ ID NO: 77243 - DNA, 601 bp, Human; identical to SEQ ID NO: 34537

SEQ ID NO: 77244 - DNA, 601 bp, Human; identical to SEQ ID NO: 34538

SEQ ID NO: 77245 - DNA, 601 bp, Human
tgaagggctgccctggccagggagcctcgaatcttcagtctctcagagaccacagctggggttataagtttatagttgggaacttccttacagagtttgtcataggtagctttgtcaaacaagactaagttattgagcttgtcccgaactttgcctttggaccacttcttctttttggccttgcccccggatttgttcactgggtctttgtctttcttggctgactttccagcgtccttcttctcgtcgtccttgggcggcattgcgaagctcggagagtagcagcagacaccgcagcctygccaagatgtcggacaaaaaagctacaaatgtttttatttaatgaacctttattttgttattattatgtcatgttatggctctaaaactgtatgtattaactcatctaatccttatcacaccatactattgttaactccattttacaaagagagaaactggggcctagagatgtagcaatttgctcaaggcccaccactagtacgtggcagagccaaggcttgagcacaggcaggtgaccctgggtctctgttcttaacctcttgctgtgctacttagaatagtaatcgcttcgtactaa

SEQ ID NO: 77246 - DNA, 601 bp, Human
acagtattgtattctgctcaatagcaggaatgatacagttctgggcaccccaagtctcaggtactggtcaagcaatgtttcagtgaacaggtgtatatgtatggtgggtagggaagggaaacaaaggaacgccacagtggttgtcatgattggctatgtatacgtgggtagagattgattctctaggcataagcctctggctatatataatttttttccaaagccccccttttttcccatttgcagatacagttgttttgcctctcttccttcccagagctttggaaaagagaaatacaamtaaaaacctggtaaatactaatgtcaaaataaaatatattaaattcggatttcaagcacagaagacttaagtgtggccaataactgttttaaaaaagtggaaaccatgtgttaagggtttcaggaccatctcaatttcatagataggtcctagcaacaaccaacatgttgacatttaaatttgttttgaatggaaaacaaaattgcattggttatattgacattaaaaggaaataatgccagtggaatagagggcaaagagtttggagatgatggtctgagttactgagtcactacaaag

SEQ ID NO: 77247 - DNA, 601 bp, Human
ctacaggaagctgggcagtggtctcacacatactgcattcacaagcagtgtctggcaaaatgtagttagcaatagaatatgcaaagagcgtgcctaaagacacacttattttggcaggaaggcagtataacagacacatgcatgtcatattccccaggtaaaagccacttccaagcagtttccattttaaaaggtaagattctgaaggacatatatgcatgtctttcagagttgaaattaaaagtttgttttaagggcaaatgatctatttatcagtttactaagaaagtttacaaatagmggatgggcatttctagaaggggattttcttgttaggaaaagtaagctagcttcatggaatttctgagctgcaagagactttggggatcatgctgatttggagctgagtgagtgcaaatgaaagttatccatctaggtccttgttttattttaataattctgcaggatgttacaggagcccatttttccatagaggactaggtttaaattttgacttcctaagccagaagaccagaagcacatttgagaggtgtaaaggaagcatacctcccaaagcatttgagtggtagggcaaactcta

SEQ ID NO: 77248 - DNA, 601 bp, Human
aatagcatgtatgcacctttttctaggacattggtttttaacatcatttttattactggtcactaatttgatgaattaggaaaatgcacatacaccacacattattttgcatacagtttaagctgattgttggacctcccctactaaggctgtgcatcaggaattggcaaactgcagccttagggtcaaattcagccggtttttacagctgggagctaaaaatggattttaatttttaaagggttgtaaacacacaacacatacacaatatatacaacaaaggcctttggcctccaaagcstaaaatattacttgtttggcctttttcataaaacatttgcagatccctactatacataaacactaagttaaggaggacctgacctaaagactctaggtcagctgcagttaatgagtcccccagtactaaaatggagtacatggtagttagctcaggataggaaagacaattctgattagaaaggcagtatagcaaggtgggtaacagtccagatttggagctagaccaagggcggggttggcggggggtgttcaaattcccaccatacctcttactagctatgtgaccctagtcaaatta

SEQ ID NO: 77249 - DNA, 601 bp, Human
atgataggtattgtattagtctgttttcacattgttataaagaaatacctgagagtgggtaatttataaaggaaagaggtttaattgactcacagttccacatgactggggaggcctcaggaaacttaaaattatggcagaaggtgaaggggaagtagataaccttcttcacaaggcagcaggagagagagaaagagagagagagaaagcaggggaaactgccacttttaaagccatcagatcttttgagaactccctcactatcacaagaacagcatgggggaaactgcccccatgatcygatcacttcctaccgggttcctccctggacacatggggattacaattcaagatgagatttgggtggggatataaagccaaaccatatcattccactcctggcgcctcccaaatctcatgtctttttcacatttcaaaaccaatcatgactttccaacagtcccccaaagtcttaacttattccagcattaacccaaaagtccaagtccaaagtctcatctgagacaaggcaagtcccttttgcctatgagcctataaaataaaaaacaagttagttacttctaagatacagtagggctat

SEQ ID NO: 77250 - DNA, 601 bp, Human
aagaggtatctagaaggtacacagagaggagaaccagggactgccacagaagagttgctatttgacctgagtcttgggtagttagtagtttttagtagtttgctaggtagccctaagggaaagggacattttttgttttgtttttatcttgagatggagtctcactctgttgcccaggcagactgcagtggcacaatctcagttcactgcaacctctgactcctgaggcaagcaatcctctggcctcctgagctcgagcaatcctcctgcttcagcctcctaagtagctgggactataggygcttgccaccatgcctggctaatttttgaattttttgtagagatggggtttctccatgttgcccaggctggtctggaacacttgggctcaagcaatccacttgccttggcctcccaaagtcctgggattataggcatgagccaccacacccaactgaaaaggacatttctgatggagaagagcctctacaaaagttaagatttgtgaaagagcgtggcatgtccacacaaccagatgtcctttgatgtgcctggagcatagagtgtgtgtactaggagatggtgtaatggaggtgggtaa

SEQ ID NO: 77251 - DNA, 601 bp, Human
attataggcatgagccaccacacccaactgaaaaggacatttctgatggagaagagcctctacaaaagttaagatttgtgaaagagcgtggcatgtccacacaaccagatgtcctttgatgtgcctggagcatagagtgtgtgtactaggagatggtgtaatggaggtgggtaaggatcatatcctaatgggccttgaatacctggatggtgggggttggactttatgctttgaaaattcaggagaaagatggattgtgtagattttgggccacacactgtgggcagaaaacaggacatayatgtataggtaagtattagccattttctacttaatctgcttctttaagtattagctgttaggtaggactagactacaattcaggcatttggaattttaatacttaacataaaaaaggtgtgcaaaggcttgtcttaactctttagttttttgttttttgtttttttttgagatggaggttcactcttgttgcccaggctggagtgcaatggtgcaatcttggcccactgcaacctccgcctcccaggttcaagtgattgtcctgcctcactctcccaagtatctgggctaacaggcatga

SEQ ID NO: 77252 - DNA, 601 bp, Human
ataacttgtattatagttttgaccttggaaccattgaaatgttttatgtaattaagaatcccaatatgttaataagttggaaagaaaaagcaattgctaaaaattgaaaacaagcacattaatctaaagatctatcaaattggtgccataactaggtattgaaaataattattcaagtgactttaaaaacccagtattgtgattatacattcctaataagatcagtctaatgaacaaaaataattaggcctgggcatagtggttcacgcctgtaatcccagcactttgggagatcaaggcraatgggtcacttgaggccaggagttcgagaccagcctggccaacatgttgaaaccccatctctactaaaaatacaaaaattagccgggtgtggtggtgaacatctgtaatctcggctacttaggaggctgaggcaggagaatcgcttgaacccgggaggcagagtttgcagtgagtgaaatcatgccactgcactccagcctgggcaacagagtgagactcttgtcacaagaaacaaaaacaaagaattggaaagaaatttgaaactgcattcaaaaaaattaacattgttactttgaaa

SEQ ID NO: 77253 - DNA, 601 bp, Human
ctgaaagttttagccgcgcttacgcctgtaatcccagcactttgggaggctgaggtgggcggatcacagggtcaggagattgagaccatcctggctaacacggtgaaaccctgtatctactaaaaaatattttaaaaaattagccgggtgtggtggcggcctctgtagttcagctgctcgggaggctgaggcgggagaatggcgtgaacctgggaggtggagcttgcagtgcgccaagatcgcgccactgcactccagcctgggcgacagagtgagagtctgtcacaaaaaaaaaaaaaaraaactgaaagttttaaagtgagagaaaagcgttatgagaataaagaagtagaagcgatcttaaagttaaatggggaatagttatataaacttgtgatttatttttctctgtctaaaaaaagtacatatttctttgttttttgcacagtaaagatttagaagcagtgacaactgagtagcagtgaatattcttagtgccctgagtatggcctctaaatactgtttgccactaacaggaatagtgtctttggagaagtcatttattccagagctgagcaggaatgcaagatatcttcttgtg

SEQ ID NO: 77254 - DNA, 601 bp, Human
ggcggcctctgtagttcagctgctcgggaggctgaggcgggagaatggcgtgaacctgggaggtggagcttgcagtgcgccaagatcgcgccactgcactccagcctgggcgacagagtgagagtctgtcacaaaaaaaaaaaaaagaaactgaaagttttaaagtgagagaaaagcgttatgagaataaagaagtagaagcgatcttaaagttaaatggggaatagttatataaacttgtgatttatttttctctgtctaaaaaaagtacatatttctttgttttttgcacagtaaagayttagaagcagtgacaactgagtagcagtgaatattcttagtgccctgagtatggcctctaaatactgtttgccactaacaggaatagtgtctttggagaagtcatttattccagagctgagcaggaatgcaagatatcttcttgtgtcagaaagcaggaaagctatgaaaggccgctggagacatatcaaaggtttagaaggtacaacttgaagggactctcactggccgaagatgagactattggaacaaccaaaagaatgaaagcaatgaatttaaacgccacacacacacacacaca

SEQ ID NO: 77255 - DNA, 601 bp, Human
cactccagcctgggcgacagagtgagagtctgtcacaaaaaaaaaaaaaagaaactgaaagttttaaagtgagagaaaagcgttatgagaataaagaagtagaagcgatcttaaagttaaatggggaatagttatataaacttgtgatttatttttctctgtctaaaaaaagtacatatttctttgttttttgcacagtaaagatttagaagcagtgacaactgagtagcagtgaatattcttagtgccctgagtatggcctctaaatactgtttgccactaacaggaatagtgtctttgsagaagtcatttattccagagctgagcaggaatgcaagatatcttcttgtgtcagaaagcaggaaagctatgaaaggccgctggagacatatcaaaggtttagaaggtacaacttgaagggactctcactggccgaagatgagactattggaacaaccaaaagaatgaaagcaatgaatttaaacgccacacacacacacacacacacacacacacacacgtacatgtattttcagtccttacgtggagatggagttgtgattaggaaaaatgtagtcaccattgaagattattaggacat

SEQ ID NO: 77256 - DNA, 601 bp, Human
agtagattaaatatgagctctttgggaattggtttcagtaataaaatttgtcctctcaaactgtggttttgatgaggttcagatttcataaagcagcacaaaacattgtgcggtgggtttttttcttttcccattttcctggttaattttcttcaccactgccaagagtaatttaatcagataggcctctagaggaccctgctcttaaagcataaagtcaggcactgcatatctctcttcctttttatatttaatttgaccatttgccatgcccactatttgagtgggtgtggacggggargttgggaataaggaagagatggaagaggagactaatagaagatgtgcttttcattcagatttgtttctcttttccttcattcattccagaaacttttattaactctactgtgtgcaagatactgtaccaggctagctgggaagacaaaacaccttaggcatgcccttgccctcctggggtccttgcactgtctggggaggcaggattctggttgtctaatgtctaatgtggtaagcgctgtgaatgtatgcagtgttatgggaagggaggatttgtctggggaaggggcagggagggcat

SEQ ID NO: 77257 - DNA, 601 bp, Human
taatttaatcagataggcctctagaggaccctgctcttaaagcataaagtcaggcactgcatatctctcttcctttttatatttaatttgaccatttgccatgcccactatttgagtgggtgtggacggggaggttgggaataaggaagagatggaagaggagactaatagaagatgtgcttttcattcagatttgtttctcttttccttcattcattccagaaacttttattaactctactgtgtgcaagatactgtaccaggctagctgggaagacaaaacaccttaggcatgcccttrccctcctggggtccttgcactgtctggggaggcaggattctggttgtctaatgtctaatgtggtaagcgctgtgaatgtatgcagtgttatgggaagggaggatttgtctggggaaggggcagggagggcatcctttggtctaaaggggaagttggaatgaattattcaagtggagaggccagggtagtagtgttagaggcaaatgaaagagcatgcttgaccagagaggatagagcctgtgtgcttagagctgtcagcgttttggccattgtgccaagatcagtggaaagacattgcag

SEQ ID NO: 77258 - DNA, 601 bp, Human
tctttaactgcactcaagtctctgcacagagaggtctttcctggccattttgttgagaagtgaccccctgcccttgtcattattttctgttctccttactctgctttttctttgtagtttttaaaaaaattgcaacttgaaattatacatttatttatagcatgtttgctgctgctaaaatataagatccatgggggctggtcttatctaaaattgtaacctcctttccccccgtgcctagtacatagtaggtgctcaataaatatttgttgaatagatgagtgaattgattgaagttggsataatggaattcattcttcccttttcagctgtttctcaaacatctctctggctgtgaacttttttcagagcttgaggttaatgcccaaaccctgtcttgctgtcacctcaaactcagtatatataaaattacattattttccttcctccagtctttcacttttgttaatgctgccatcactgacagtcctcaggcacaaaaccttggtgttatcttgcagtgttcactacccccgatccctagggtgctgtatattcccatttatgtgtttgaggaagttttctggttactgtttcacct

SEQ ID NO: 77259 - DNA, 601 bp, Human
caggctggattctcttgagccggtggaggctcctgcagttttagaaggtgagtagtcataaggtgtcacctgctgcatcacactggaaatgtgtggaggcagtggagtctgagctgatgatgagtatttacttagtagttctctgtacctacctagcagtgattcaggttgtaaagaaaaatttaattggttaaattattttaaccaatgtttgagtgcctattttactgtgatgaacatagatgtacaagatgttttgctcattaggagtctccaaaatctagcaggtatgtgagttatstaacattctttttagtaaataaaatatggtaaatgctgagttagaagtaggtgtgagctgctgttgaaggcagcatatgactcattgaaggacttatcaggggaggcttatttcgtaagggatgtaatggggcacgtcttgatggataaatggaaattcacaagtggagaggggctttaagatctgtgtataggtaattcatgaaaacacagtggaatcaatctaggcccaaatgtagctccagtaaagggtgaaaccagcaggggtagagctttagttccttgatatcatggcttaagg

SEQ ID NO: 77260 - DNA, 601 bp, Human
tactagctttgggactctggacaagttacttaacctctctgggccttgatatagtatctacttcatataaatgaagattaaatgaaataaaatacataaagtgcttatgaacaggatctgacactcagagtgttcaataaaggtttgctatttttatttttgactgtttacatcagcctagagcaggggttggcaaactacgtcatgtggaccaggaccaaatctggcctgcagttagatttacaaataaagtttttttggaatcaagccatgcgcattcattcggtattgactatggctkcttggtgtgtgctataagagctgggtttagtagttgtgacagtgaccaaatagcctgtaaaatctaaagtatttaccatatggccctttatagaagaaatgtaccttttttgaagaaacttaccatttactatatggtcctttgtaggcgaaatttagaggataaaatcaaactccttagctctcaagatcttcagtgattgcttccaaaccagccttttttctatccataactaacagatggccacagcagctctttggttttcactggcccttctattccttttatagctgctgtctg

SEQ ID NO: 77261 - DNA, 601 bp, Human
tccaactactcttctgtcttttgcgtgaatatgggcagaggcagggccaggactagggtagaatgtgtgaggcactcactctaggtacacaatttaagggggccccaaaaaacttgataatcaagataatttgttaatgtttttaaaaataaaaattaatgcaaaaaacccattatgaacaaaatatcgatattttactttttttgaagcttaatattaattttattaaacttttttccaggtttattatgattggcaaataaaaatttgtaggctgggcacggtggctcatgcctgtaawcctagcactttgggaggctgaggcggtaggactgcttgagcctaggagtttgagaccagcctggggaacatggtgagacactgtctctacagaaaataagaaaaaaattagctgggtgtggtggcacgcaagcgtgactccagctacttaggaggctgaggtgtgggaggaccgcttgagcccaggaggtcatcgctgcagtgagctgagattgtgcccactgcactccagcctgggcgactgcgcaagaccctgttttggaaaaaaaaaagaaaaatctaagttgtacagcttagggtt

SEQ ID NO: 77262 - DNA, 601 bp, Human
atattaattgaattttaatgctttccaataaacattgacccagcaagcttttttagatgactaactttctaatctgctttgacatttcttcgtggggctgcaaacagtgatttgttggtaggttttaaaatatgtataatttgttttagtgaagaaggtttggaagtatactgtagaattctgtgaaagcagaatggagtcttatctgtaaggaataagtctggaggaatggacaagatcaacttttcatttctcagacaccttgttgagatggataggaattatttgatgttttgacatrgtaaattagttgttctgcctctcattgttatataacaagagataaaatgcaatgttgaacttgatggtcttttgctttctaaacacttttcaatgtttttaggtgtatagtgttgattggagccaaaccagaggtgaacagcttgtggtgtctggctcatgggatcaaactgtcaaattggtatgttagcattattgtattcaaaaacgaatattcccttctctagagcttccactaaattttcttctctttttccaacatacttctgtagctctatgattcgacagctgagctttcttt

SEQ ID NO: 77263 - DNA, 601 bp, Human
ttgaatttttaagctaagtcatagctttttttgtccataatctgaattaaatcttttctaatatatgaagtcttttgggatgggaccagtaatatattttttcttcttatgttgcctttcccaagcctgcatccttctttggtcttttatccttctgtaacatagttaaccgtaaggctgagtgtgcattaagtcagtggtagcaatattaatatatttaatttgaatcaattaaccctttcatttacatgtataacttgagttaatcatcttttatgtttttattattattattgagtcrgagtctagctctgtcgcccaggctggagtgcagtggtacaatctcggctcactgcaacctccgcctcccgggttcaagcaattctcctgcctcagccttctgagtacaggtgtgcgccatcacacccagctaatttttgtatttttagtagagacagggtttcaccatgttggctaggctggtctcgaactcctgacctcaggtgatcaacccgccttggcctcccaaagtgttgggattacaggtgtgagctactgcgcctggcctgtgtttttaatttagtataaatggtaatgagtt

SEQ ID NO: 77264 - DNA, 601 bp, Human
tctcctgcctcagcctcccgagtagctgggattacaggcacgtgccactatgcccggctaatttttgtatttttagtagagccgggctttcgccttgttggccaggctggtctcaagctcctgacctcaggtaatccgcctgccttggcctcccaaagtgctgggagtataggcatgagccaccgtgcccggcctatttaaggttctaaatttgccttgatttgggcatttttgtttgtttgtttgttttcagtttgttttctctgacaggatacatgaccatgacaaacacccagtttgyctgagttttaaaaaggatatttcgtttgccccactggaatgaccagtaaagacatacatccagttggcaaagtggaaagagggtattgatttgtttttaatcattgttctctttatgcgtatgaccaaatataaatctgatagtgacaaaatcacaaactaatacagctgcattttttggacgtcagtcagaattgtgtgtattagcccttcatttgagctgagtcacacacctcttctttttacattggtctttgtgtagcatggaatacatagcattgactctggatagtgctgtaga

SEQ ID NO: 77265 - DNA, 601 bp, Human
catagcattgactctggatagtgctgtagaatatgcactgtatgagactgaataacagaagatgaattgtttctagagtgttgctataatcacaacacttcacttttcaaactatctgtacagtgtaagtgggtagtagaaaagtgatcttttatcaacagaatgactgtttgcttctgtagaagacccctgtttcattacattaccttcatatgttgtgttagaaattaatataaatcttggtcatatcagccaggacttctttggttgaaagtaaaaaaaaaaaaaaaaaaaaaaaaaattctgacccaaagtgctttaaggaagaagataacttatttgctcacataagtgaaaagttcagaattaaatctggctttataggcatggttgaatgtagggctctgtcttctgttgtgctggtttcagaatcagggtatcaggcaccacatgatggcaagatagtagtagctccaacacctacctcttttctggtttctgtccagtaggagaaagtgaaagattccttctcagacatccagactgtttcattttctgtcatgggctctgatgcgtccttgtggatgttcctgaactaatc

SEQ ID NO: 77266 - DNA, 601 bp, Human
caaatattagtctacttagtactttttaaaagattcaaagttcttcttccactctgcaaaaatattggaatgagttggggtgtagtaaaaagtcaatgcaagttgcaaaactctcactgtgccttagccatttcagagacaagaacatttactcactgggctgtgtaccatgcgtttgtaagcaaatgcagtgcttagatcttctttgcttcacttgttttcatacatttcctataacacttgtgtattcttttacatagccgaatgccttacatagccaaacacgaaaatatttttgatwgttattatataagatatgggagtaaccatcttattcaaatttttaaaacatactgagttcattttgattgttgagaaggacgctgctagtgagtcagtcagatatttattgaatgtccatcatttattggagattcagtgaggaagacaacagatggagttcctgcactcttagagcatatagtccagtaggaaagaggaatgctaagacaaaatctagaagcagctagtgatgaagactgtgaagttctttaaggagaggtaatatagcacagtggtcaggaacaaggattctggagct

SEQ ID NO: 77267 - DNA, 601 bp, Human
ttctttggtcatgccatttaaacctctgtctcctcattcctcatttctaaaatcagggtgataatggtatccacatcatggagttttgaggaggattaagtggctaatgtgcataaagggcttagttagaacagtgactggcagagtaaaagctctgtgagcattacctctttttttttgagacagggtctggctctgttgcccggctggaatgcagtggtgccatctcagctcactgaaacctctgcctcctgggctcaaacaatcctcccacctcagcctactagctagggccacaggygtgcgccaccacccagctaatttttgtatttttggtagagacagggtttcaccatgttgcccaggctggtctagaactcctgggctcaagcaatcctcccgccttcagcctcccaaagtgctgggattacaggcatgagccactgcacccgaccttaagtattacctgttattattaacacgtgtgcccagaattctgtggaaatgtataaatggattcctgagcttgtcagggttggctggtcaggtcacttccctgaagaaatagtctaagctgctgccttatggacaagtaagagga

SEQ ID NO: 77268 - DNA, 601 bp, Human
tttctaaaatcagggtgataatggtatccacatcatggagttttgaggaggattaagtggctaatgtgcataaagggcttagttagaacagtgactggcagagtaaaagctctgtgagcattacctctttttttttgagacagggtctggctctgttgcccggctggaatgcagtggtgccatctcagctcactgaaacctctgcctcctgggctcaaacaatcctcccacctcagcctactagctagggccacaggcgtgcgccaccacccagctaatttttgtatttttggtagagacrgggtttcaccatgttgcccaggctggtctagaactcctgggctcaagcaatcctcccgccttcagcctcccaaagtgctgggattacaggcatgagccactgcacccgaccttaagtattacctgttattattaacacgtgtgcccagaattctgtggaaatgtataaatggattcctgagcttgtcagggttggctggtcaggtcacttccctgaagaaatagtctaagctgctgccttatggacaagtaagaggaaatgggaagtgggaggcaaaagttggaacatggagagaacaga

SEQ ID NO: 77269 - DNA, 601 bp, Human
ctagggccacaggcgtgcgccaccacccagctaatttttgtatttttggtagagacagggtttcaccatgttgcccaggctggtctagaactcctgggctcaagcaatcctcccgccttcagcctcccaaagtgctgggattacaggcatgagccactgcacccgaccttaagtattacctgttattattaacacgtgtgcccagaattctgtggaaatgtataaatggattcctgagcttgtcagggttggctggtcaggtcacttccctgaagaaatagtctaagctgctgccttatgracaagtaagaggaaatgggaagtgggaggcaaaagttggaacatggagagaacagagcatacttgaggaccatcagaatggcctttgcagtgtatatgtgctgtaacagtggacagttagtgcttatctaagagctaaaactcttggagctctagggtaatttgctctaggtagacgctggaaagcatggttgtatagtaacatactagtccagcgattctagaatctggctaatcatcagaaccattgggagagcattaaaaaacagcagcagaattgtgggcttcatcttaagtcttg

SEQ ID NO: 77270 - DNA, 601 bp, Human
tcaccatgttgcccaggctggtctagaactcctgggctcaagcaatcctcccgccttcagcctcccaaagtgctgggattacaggcatgagccactgcacccgaccttaagtattacctgttattattaacacgtgtgcccagaattctgtggaaatgtataaatggattcctgagcttgtcagggttggctggtcaggtcacttccctgaagaaatagtctaagctgctgccttatggacaagtaagaggaaatgggaagtgggaggcaaaagttggaacatggagagaacagagcatayttgaggaccatcagaatggcctttgcagtgtatatgtgctgtaacagtggacagttagtgcttatctaagagctaaaactcttggagctctagggtaatttgctctaggtagacgctggaaagcatggttgtatagtaacatactagtccagcgattctagaatctggctaatcatcagaaccattgggagagcattaaaaaacagcagcagaattgtgggcttcatcttaagtcttgctgaataaaaagacagaatacccctgggagatacatttttaaatcccagctgaatctagtga

SEQ ID NO: 77271 - DNA, 601 bp, Human
acagtgattataatgagggccgttggagttatttgaagctctaacctgtaccaattctgaacaatttccttttggtactttcaaacttatcattcatttttcacaatgagatatgttgtcactagtgggtcctgaattttataacttgtcagttctgccatagaagagggactgacattatttttcagttgtagtaagaaaaatcccaagtacccccatttggcctgtcagctgtggtctgagcaaggaatgaggtgctatggacggaggtaccatccttagctaggtccaaaaatgtttrttactctcatctatcaaagtggttttcaacctttttttaatgtagcaggacagtatttttaaatcaaaaaaggaaaaaaaatcctacatacaaagcagtagtagtacgtatttatggatccataaaaatataataaaagtattaccaaaatgcaaactaaagggctgcggaccaaattcatgactgttgtggcctctgggcagggaggatgggaagtggtattgaaaatataatagaaatttttctccgatttatagaaaaagtaatacagggctggatgcagtggctcacacctgtaat

SEQ ID NO: 77272 - DNA, 601 bp, Human
ggttctggttccaggtcctggttctgttgcttactatcctgggtgagttatttcatctttatatgctgcatttgtatagtactatattcctcatttgtatagtactatacaattacttttatatctccgaattcctactttatgtagttgtgatgtttttagaaaaaatatgtataaaatgcttagaacagtatgtggcacattggaagcactcaataaatattaactattattcatgttgttattattggggggacataaataacttctaatcatgggtattttttctcataaaaaaaaacacacatattgagagcttactgcatatcttttgcgtatctggcaccgtactcatgctactaccttgtctcatttcagccttacaaggcagttattttattgtaggtaggaaactgaagatcagcgaaataacttgattaagcatcagtggccaccaaatgattgagctggattagaaccaagctcaggaactccaaaggccctgttcttaacctctgcatttcattactgccaacacatttcttatctttcttaagcaacttccgaagaagccaggaaaaaattgcctaggatagctaaa

SEQ ID NO: 77273 - DNA, 601 bp, Human; identical to SEQ ID NO: 18403

SEQ ID NO: 77274 - DNA, 601 bp, Human; identical to SEQ ID NO: 18404

SEQ ID NO: 77275 - DNA, 601 bp, Human; identical to SEQ ID NO: 18405

SEQ ID NO: 77276 - DNA, 601 bp, Human
tctaattatatgagtcgtaaggctaagattgcttagatgaaaaaacaatgaacatgagtgtatgattttttgtgaatgtagatatatgaacatgtatgtgtatatatgtgcatggatatctagataagagtgtgtgtgggtgtgggtctctatttatacttccagttacagttccataccacagaggatttattttccctttccaaatttgtaactcttgacttccattttattcacaatatattttcttatgtgttaaaccctgtaatgcttagaaagtagttcagaattgcaaagccayacctttgaaaaaaacaatcttactaattagagctcagcacttgcttagagttttttttgtctttagtttgaatactatattcagaagttacttaggttaattctcctcttctctgttagagtgtggttatgttattcacttgaaacatggtttgattcctttgtttctgtttgtattcaattttagggttttcctcccatccttgttgattttgtctaggcaaaacattgacatggtttcaaaagtcaagatgtacataaagatatattcagaaaggtttccaggattttcactaaaata

SEQ ID NO: 77277 - DNA, 601 bp, Human
tgactttaatgcaaattatatatgtttacttgtttgtcatactaagaaagtatgcatgaattcctattttcttgagtttttttaattaggaatgggtcttaagttttgttgaaggctttttttcccagcatttatggagataatcatgatttttcttcttagagatatggctatgatgtattatattaatggattgaaccaaccttgcattcctggagtaagtctctcacgttctttgtgtatcattttctcaccatggtgttgaattgtgtttgctaatattttatttaaagcttttgcrtcaatattcaaaggtgatattagttgcagttttctttcttttctcgttttgtttaatgtgtctgtgttttacttgcttcataaaaagaattaagaaattttcctttgtttccaaagctctggaacaacttgtacagcattgaggctatttggtctttgaatcctttgtaggattgctctgcaaaactagtggagcatggtgctttttgtggagtactttcttgataacttcatttctttcatggaagtgagtctgtttaaactttgtatctctaatgggatcaagtttggaaattgtccc

SEQ ID NO: 77278 - DNA, 601 bp, Human
taatattttatttaaagcttttgcgtcaatattcaaaggtgatattagttgcagttttctttcttttctcgttttgtttaatgtgtctgtgttttacttgcttcataaaaagaattaagaaattttcctttgtttccaaagctctggaacaacttgtacagcattgaggctatttggtctttgaatcctttgtaggattgctctgcaaaactagtggagcatggtgctttttgtggagtactttcttgataacttcatttctttcatggaagtgagtctgtttaaactttgtatctctaaygggatcaagtttggaaattgtcccttgcttttaggttttcaaatttattcgtagaggtgtctgtaaagtgggtggacacagtggctcatgcctgtattcccagcactttgggaggccaaggtgggcagatcacctgaggttaagggttcaagaccagcctggccaacatggtgaaaccctgtctctactaaaaatagaaaaattagccaggcatgatggcaggtgcctgtaatcccagctacttgggaggctgaggtggaattgcttgaacccagaaggcagagattgcagtgagctaaa

SEQ ID NO: 77279 - DNA, 601 bp, Human
caggtggcagaagttgcagtgagccgagatcgtgccattgcactccagcctgggcaacaagagcaaaactctgtctcaaaaaagaaaaaaaaagaacttttttttttttattaatcactgcttttatttttattatttcctttttggtactttctttttgttgttctttttttcagcttcttgagataggaatttatttttattctttcattttgttaaagtatttaaggctataaatttttttctggttattattcaaactatagcccatagattctgatatataatgttttcattatcwttttaaaacatttgtaagttctgtttatacttgccttttcttccaagaggtgtataataggaaattatttagtttccatatgaaaatgccttttaacttaaaaaaatttgttaataatttctacttttattgcattaaaatcagagaatactattttagtcattctgttctatggaacatattgaaatttgggggaagtggaacctaataaatgatcagtttttgtgaatgtttcatttgcagttcagaagaatgtacagtctccattttcaggctgtaaagttcagtatataatcataa

SEQ ID NO: 77280 - DNA, 601 bp, Human
atttttattctttcattttgttaaagtatttaaggctataaatttttttctggttattattcaaactatagcccatagattctgatatataatgttttcattatcattttaaaacatttgtaagttctgtttatacttgccttttcttccaagaggtgtataataggaaattatttagtttccatatgaaaatgccttttaacttaaaaaaatttgttaataatttctacttttattgcattaaaatcagagaatactattttagtcattctgttctatggaacatattgaaatttggggraagtggaacctaataaatgatcagtttttgtgaatgtttcatttgcagttcagaagaatgtacagtctccattttcaggctgtaaagttcagtatataatcataagcttacaaattgattatgttgtttaggccttctgtatcccttcttattattggtccacttagtctgagaatggtatgttactgagagtggtatgttaaaatctcctatcattagcaggcttctatatctccctgcatcttttgtagttttgattttatagaaacagatgctgtgtttctggtatgtagatattat

SEQ ID NO: 77281 - DNA, 601 bp, Human
tgagaacacgcggtgttcggttttctgttcctgtgttagtttgctgagaatgatgtttccagcttcatccctgcccctgcaaaggacatgaactcatcattttttatggctgtatagtgttccatggtgtatatgtgccacattttctttatccagcctatcattgatgggcatttgggttggttccaagtctttgctattgtgaacagtgctgcaataaacatatgtgtgcatgtgtctttattgtagaatgatttataatcctttgggtatatacccagtaatgggattgctgggtcaratggtgtttctgattctagatccttgaggaatcaccacactgtcttccacaatggttgaactaatttacactcccaccaacagtgtaaaagccttcgtatttctccatatcctctctagcatctgttatttcttgactttttaatgatcaccattctaactgttgtgaggtggtatctcattgtggttttgatttgcatttctctaatgactggtgatgatgagctttttttcatatgtttgttggccacattaatatcttcttttgagaagtgactgttcatatccttcacccactttt

SEQ ID NO: 77282 - DNA, 601 bp, Human
ctgtttatgtgatgggttatgtttattgatttgtgtattttgaacccccatacctttatttttaaacagttttgttgaaccattttgttctaggtatgtttttgtatagagtatatattaggatctcgcttagtgaacaaatagtctttttattagaatatgtaagtttaactctttcatatttcttgataaaaatgtttagcatcgaatgtgtcatattttatgttatgattattatttgtattttatttgctatgtttctgtgtgtgatgtgcttttttgttgtgtttttttctttgataaattttttttgacatttaggtaagtttttatatgttttagtggttgcctttggtgttacaactttttaaatgccttcataagttttctgaaaaaaattaaccgtttattgcctggttgtgagtttttcattatatttttgtgaaatcccacctatttcttatataataaccagtgaacttgttctactttcgcttttttttcccttttccatcaaattttgtttcatttatgctttgttagaacatgcaacatgtaacatatagcacatatcatatgatatatttttacttagtttcta

SEQ ID NO: 77283 - DNA, 601 bp, Human
tctgggactacaggcacacatcaccacacccagctaatctttgtatgtttagtagagacagggttttaccatgttggccaggctggtctcgaactcctgacctcaagtgatctgcccaccacagcctcccaaagtgctgggattataggcgtgagcccccgcacctggccctttgcctctcttctaaagccatctttccaaccctattccctgcacattcagcaaaagatcttacctttaaaataataataataataataattgtgggactcaagcacaaattatcttaatttctaagctrggcctgcagattttctctaaatctgtacctcttcattcctcctgttatttagatcccttagacatgtgtgctgttgatccctcgtacttgttttcttcaggactttacgccgtgaagtgacctgttctccccctatatctctctatatctttagtctccaactctttagtgactttttcctcagcctgtaacattttccttcatcctgcatttgcctttaactcctctcttacatctctcttttttacttagccaagcttttagtgtccgcataagcttccattcaccagggccatttta

SEQ ID NO: 77284 - DNA, 601 bp, Human
tcaagcacaaattatcttaatttctaagctaggcctgcagattttctctaaatctgtacctcttcattcctcctgttatttagatcccttagacatgtgtgctgttgatccctcgtacttgttttcttcaggactttacgccgtgaagtgacctgttctccccctatatctctctatatctttagtctccaactctttagtgactttttcctcagcctgtaacattttccttcatcctgcatttgcctttaactcctctcttacatctctcttttttacttagccaagcttttagtgtccscataagcttccattcaccagggccattttaaggtcttcactgtcccagcgtactctgtgttggaggtcttaccctggatcactagaacctataaaatggatctacatcactgattaaatagggttaattattttgaaaagatttgtggcttttgcttttgaagtgatttggattgagtaagtcacttatgattgattatgacttcttggcaatcattatgcttgctaaggaattcatgtgaagtaaaaaagaaacatccctaacctagaaattgtttccgagtggaatgaaatgtttctg

SEQ ID NO: 77285 - DNA, 601 bp, Human
atctctcttttttacttagccaagcttttagtgtccgcataagcttccattcaccagggccattttaaggtcttcactgtcccagcgtactctgtgttggaggtcttaccctggatcactagaacctataaaatggatctacatcactgattaaatagggttaattattttgaaaagatttgtggcttttgcttttgaagtgatttggattgagtaagtcacttatgattgattatgacttcttggcaatcattatgcttgctaaggaattcatgtgaagtaaaaaagaaacatccctaayctagaaattgtttccgagtggaatgaaatgtttctgagtgccaggtttatcaattagtaatgttaatttattaattttaaatttaattattttaagtttaatttaaatgttcaggtctcaggcatttttgtagacctttgaaagcttataggcataggcacttaaggttcttcctaatggcacaactagcttcagtccctccttctttactgaaattgctctggcaaaagccactagcgacctctgtaaaaccaaatccagtccacttgtcagcatttgtcatgctgaacctttttctgt

SEQ ID NO: 77286 - DNA, 601 bp, Human
atttaccaaatataatagaagctttaagacctttacctctgtagtagctcattacatttcacagaataactaatgaagatctaagaagtgatatataacatagcattggaaattgtttagtatggtttatgttaaataaaaacttcaacttttatgaagaatatcagaactcccttcagctggtggacaatatagtctatcaaaatacatcttgattctttctaaacttcactcaagataatactaaagttaaaatgtttcatagtagattatttctattcttccatgaatgttatcatcrtagattttagcatattatctttttcctatatactgtcccttaagttagttaacttctcttcctgccaagccacatttgttgtgccaaccgtgcataagcattatttgagttgtaaatgcttgtttttggtttcataccaagtagatcatttcataaacagaaaagcaaaccaggtatgtgtgacaaccaaacaaaagtaaaagctgttataattcatagtttttttcattaggaagagcagcattccgtgtcttccacattgtagcaaattctcagatatctgaagattttaattgataa

SEQ ID NO: 77287 - DNA, 601 bp, Human
ctaaagttaaaatgtttcatagtagattatttctattcttccatgaatgttatcatcgtagattttagcatattatctttttcctatatactgtcccttaagttagttaacttctcttcctgccaagccacatttgttgtgccaaccgtgcataagcattatttgagttgtaaatgcttgtttttggtttcataccaagtagatcatttcataaacagaaaagcaaaccaggtatgtgtgacaaccaaacaaaagtaaaagctgttataattcatagtttttttcattaggaagagcagcrttccgtgtcttccacattgtagcaaattctcagatatctgaagattttaattgataaagctaaaatgaccagtttagcctcagagtaacactccagtttcatgatacttttataaatattataacctttaaaacttttttatcagtggtcttaatggcctttgataataataagccagaccaagcacttaatttttttagacatatggatttgggggcaagaaaaatataaagtgaattttaatttcagtgttgtcaaactgtattcagccacagtttgcgtgatgtgagtctctctctg

SEQ ID NO: 77288 - DNA, 601 bp, Human
tatgtcagcaacattaatgtttccaactcaactgttaagctactttttggtgacaaaattgtacaactgtactctactttaaaattcaggcatatttacagaatgtctgttatctgccagccattgtaatagacagtttgaaatgtctttttgaggaaatgataaaaatgaaggcttggagacaagtagtaacacacctaggagaaccctaagcctgtcagttttgttggtatcgtgggacatatgtagtcacaaatgtaaatagggagtactggaagatatatattcaatagagtaattrtgggttggcacattcccaggtaacatagtaggaccacagactttggagccagactgccttctactagctgtataaacttgagcaagttattttaaaacttgatggctcagtttccccatccctgtaaatggagatgctaatagtacccaccacatgggattgttgtgatggttagaagagctaatatacacaaatactggtacatagtaagtactatgtaagtgtttgctacttttgtcattattaaggctagaatggatggtgacagaaggctgtctccttgggcttgaggccatttca

SEQ ID NO: 77289 - DNA, 601 bp, Human
acttgagcaagttattttaaaacttgatggctcagtttccccatccctgtaaatggagatgctaatagtacccaccacatgggattgttgtgatggttagaagagctaatatacacaaatactggtacatagtaagtactatgtaagtgtttgctacttttgtcattattaaggctagaatggatggtgacagaaggctgtctccttgggcttgaggccatttcagcgctctagtcttcaagagtgaggtaattttattttacagcagtaagagcaagcagccccatctagccttttgttrccctctgctccttggaggtgaaagagaagtacgaattggggataggaagttatctagaatcagctctgtccttccacatccctgttctttggagatatttagaaacgttctatagattagacatctattatgtagtggggtgagcatgtagacctttgagtgagtcatacttgaagtgaaaagctgactcctctatttactagttgtgaaatatgggaaatgatactgtgatctaccttgctgggatgttcagaggattaaatgaagtagtatctgtaaatactctggcacataataaga

SEQ ID NO: 77290 - DNA, 601 bp, Human
ctctcataaagtgacttaacctccctgagcctttgtttcctcagtcataagatgtactgctacgagatttaaatatcaatatatgcaaggctgttcccacagagcctggcccatatctggcactcagaattttattttttattcccatatatattcttcagactttgtacttgttgtcatgtcactgtaaatatgttcttatatttctgatcaaagttgctgaaaaccagcaaaatgacaaagacaaattatgatgtctgcagtttatttttaaatggttcagcaaaaatattccttcatrtgcgtatgtgtagagagagaaagataaaacaaatgtggcaaaattttagcagttggtaaactagacaaaggacatacgggtgttcattttattctttgaggtttattgtgggttggtaattttcaaaataaaaacatttgagaaaaaagcaaactgtatttactcatgcaaaataagaccctaaaataccttctagttaatgttattatttaatgatattagtttaattgtagaataagataactagctttattatattgtgttaagtgggaaaatgatctttaattggattgtagtaaa

SEQ ID NO: 77291 - DNA, 601 bp, Human
aaatgatctttaattggattgtagtaaacttaaaatcttaaagcagaggatgcagaaataccttttatctttgtcacagatactctcatgggatttgcccttatctagtaagtgtcttaactttggtgtggctgatgggcttttttgatccttatgtttattagcacagagatttccacaggcagatacttctctttcttccccttccccttaaaaaaaggtcagccaaagtaaacagatagtatagttgaatatgtactctgcctcacaaacctttcatttcaactttgcctagtccccsttaccaacaaaaaaaggtcagtcagagtaaacagataagaaatgtggctgaatatgagctgccacacagcttcaaatgatcattttacctcatcttttaagatagttgtttttaattcctctacttttgttcatcaaaccataagaaatcatgtggctaatgatatgatactgattgttaacatttgcaggaactacagttaaattcttaggatgatcagagattttcaaaatgttctgtgccttcagatatcttagctagaaatgtctttgtaaccctatcaccgttttttgctttgtg

SEQ ID NO: 77292 - DNA, 601 bp, Human
ataaggatgaataatacaccctttgaggtctgtcctgaaaccctagtcaagagtgtggcaacactaaatattctaaaatggaattcttagacattggacttaatggaatgaaccacgtggagatttaaaaaaccgtaattattcatctattttcatcctaaataaaattcagcagagtcccttatctttctccagtatattatttacagtatgtgtgtctgtgcacacatgtgtaaaacagaaaccatccttagatagcttaaatataaacagggaaatatttctcagactatggggtccsccagagcccaaaggcagaagcacggtgtgcagtgtggcctatggaaggcattgaaactgtacagccgactttgtcattcctcctcctcctgcaggctgatttttttttctttttttacctcaagctttcatgtccagttacaagaaaaggaacagaattatttggtctgctctgtctctgtttttttctctctttgtcggtgtctgtcttctccccctcctcacccccatcaccgtgtccaccctctgctgaggagagagttgttaaataaaggagatccttgtaagcagtgcagacatt

SEQ ID NO: 77293 - DNA, 601 bp, Human
atacaaagaataggacactgtccctgaattcaaggagcttattgcctattaaaggaggatagatttgtattaagaaataaataaatgcatggaaatattatgagtactatgaatgaaacaagaaacatgagaatcttttttgatgtcttctgtttcattaatcaccaggttgtattaattcttctgcctaaataaatctccaatccatcaacttttcttcatcatcacagtcagtaccttaagtccaagctgctattacctctttttggaccactgatcttcccatacccactcaagcccwcaagtccattcttctcactgtggccagagacacctttgaaggcaaagctgatcatagaccgatgttaacagtaggggaacctggctgttgaggtgtatgggacccctcttcactatcttcacaagttatctgtaaatttagaacttttctaaatgaaaaatgtttattaaaatgttttaaaataaggcaaactgaccacacaaatttaagttgctgcttaaaatccttcagtggctttttttttctttttttaaagagaaaatcccaaattcttcaaatgacctacaagacctgtttgac

SEQ ID NO: 77294 - DNA, 601 bp, Human
aatgaaacaagaaacatgagaatcttttttgatgtcttctgtttcattaatcaccaggttgtattaattcttctgcctaaataaatctccaatccatcaacttttcttcatcatcacagtcagtaccttaagtccaagctgctattacctctttttggaccactgatcttcccatacccactcaagccctcaagtccattcttctcactgtggccagagacacctttgaaggcaaagctgatcatagaccgatgttaacagtaggggaacctggctgttgaggtgtatgggacccctcttyactatcttcacaagttatctgtaaatttagaacttttctaaatgaaaaatgtttattaaaatgttttaaaataaggcaaactgaccacacaaatttaagttgctgcttaaaatccttcagtggctttttttttctttttttaaagagaaaatcccaaattcttcaaatgacctacaagacctgtttgacctggccctgcttacgtcctggaacattcttccctttccctgcgccagcctcatgggccctctggtcacacactgtcaggctccttgcagacaagcaataagctgctcttct

SEQ ID NO: 77295 - DNA, 601 bp, Human
tattaatattgattgaaaaaattttcctgactcctgatccccttgaggtgaagaaatctgaagcttaggttgtctctgtttagtaaatcctctcaaggcaaaagctggcttcatttttccatttactgctctgggtttcagtcttgtgttggtttttactatagtgttcctcactaatgctttaatgaagttttaaggttggttatttgtttttatgtttcgtccagggtttttagttgtttttaaaatgttggtctagaaaccaggtcagccattctgttggaaatgaacctctcttagwttaggcaccataatgtatacacttggtatgttacataatttctaccagagctgtgaaatggtataatgaagtgtctttatgccattcagtagactaaccctcccttcaccaaagagtttcagcatgtattttctttgatgaactctttgcaagatgcagataaatactggatagtttttcccaggttaaaattatgtctgtgattctgtggtgtagaactctgtgaggctttgactacccattagctgtatattagagcaaattcaggtggactttttgaatagaatcacagttctcctg

SEQ ID NO: 77296 - DNA, 601 bp, Human
gtgtgccatgttgtagatcattagagaagctgaattaggatatgactctgtgatcctgaatgtgcctgccatttttatagtatgtttagaatcaaataaaaaagatgatgagcaaataaagcattagaaataaagtaccatgttatgtattgaaaacagggccaaattcttgtctgcacagtacaaatgagagcttgattatggtaaatattaccactttcagtctatggaggttaagtagaatacataatattggctcaggaaaatacatttctgtttttcttgattctaggaattataytgatgtggaatctgtaagaaaggctgtgcctcaaaaaagaagaaagatagtttcagaattacagagattttcataagagaacagatttttttcaaagaattctaattgctgttgaaatttaaattaagcctaagatctttcatgtcaattgttgagaaatgaagtcatatttaaaatcacaaaatgttagagttcatttaattcaatatccttattttatagccatgaatgcttttagaaattgctacaaaagcatactatcatctcaatgtccttgtgcaatataaaaacattttttaa

SEQ ID NO: 77297 - DNA, 601 bp, Human
tcaagttctacatgtatctccatgtttttccctctcacttttgtcagttatctattactgtgtaatgaacaacttccaggacttagtggcgtaaaacaacaattttatttgctcacaattctgtgagtcagcaatttggaccagacacaccctagcagttcttcttttggtctttcctgtggccacccatgtggttccagccatctggtggcttaactagggccgggtggtcctattaggcctcgttcaatgtgtctggtggatagtgctggttgtcttccaggccgtgtgtctctaggtrtgcccaggtctctgcacttaacagttgtgtgtttacaagagggcaagagcaaaagctgcaagtcatcttgagaattggacttggaagccacacagcattccttctgttgcaaagcaagttgcaaggccagcccagattcaaagagtgggaaatagactgtaccgtttgatgggaggacctgtgaagaattcatagtcacttaaaatctgccacactaacctgtgttggtatagtaggtggtttaagttttatttttgtttgtttgttttgagatggaatgttgctcttgttgcccaggct

SEQ ID NO: 77298 - DNA, 601 bp, Human
ataagacatggtccatgccctcaaagagctgaagacaactctttgtcttcagttgggaaaataagtacaatcaagtattatgggtacaatgaatgacttcatagaggagatgatacctaaactgattttttaaaaaagagacatctctggcagagcaaggcaaaggggacagaggagcagacagaaagggagggagaagaggagttattaaagggaagcgatcagtaaaggaacaagagcgaagaggcataagcagcatgcttggatttgaggtgtgagcccggtgcaatgagaaatgaartgggaacaaccagatcttgaagagtgaggtttttaaatttaaaagtttgactaaaaagtctataatgctctctgtagcttggattctgatctcagaatattggtagtgaatgattggctatcactattcaaaattagtgatagccaagaaattacattagtcaaaacgaggtttctcttgtgtaattttcagcctttgtaataagcatgaaaggctgggaaatggagtgcaaatacttttggtcaaaagcactctcttgctacttcatctttcattttactgcctaccttgtttcttttc

SEQ ID NO: 77299 - DNA, 601 bp, Human
gatgttgagcacttttttatgtgcttacttttgcccatcatttttcattagattgccttttattattgagttgtattggttctttatgtattcttgatacaagttgtcaggtgtatattttatgaatattttatataactgtgtcttgcctgttcattttcttaacagtgtcttttgatgagcaaaagttttatttttgattgagtgtaacttaccaaatttttgattattactttttgtatccctaagaaatctttacttacctctgtattgagaatatattttcctttttttttttctraaagtgttatacagtttgcttttatatttaggtctgtggtgcatctcaaattcatttttatgtgcaaagttggggtcaggattcacttttttccctatggatattcagttgttctgccaccatttattgaaaagactattttttccttttgctctttaattgttttggtacctttgttgaaagccatttgtccaagtgtggggcctatttctgaactctgttctcttcctttgatctacttgtctttatcctaatcctgcacagtcttgattacagtagtttcgtgctgagtctggaagt

SEQ ID NO: 77300 - DNA, 601 bp, Human; identical to SEQ ID NO: 18406

SEQ ID NO: 77301 - DNA, 601 bp, Human
gaatgaaaactggagacccattaggttattggagtaatcgccatatcaagatcactccgaatatgctcatgttagagggggttagtagccaagtttcttagttctcttctttgtttgactggtgagtgagcagaagagggcaaaaaccgaaatcactggagatgttaatggtttgctgaataaatagacattaagtaattgctgtaagtaagaggcggtgctactgacaaagtcagataggacctagccctagcttccccagttaaatactgtcaagcgtgatctgccctctgcttccttstgtagttttatatttggggctttgactgacaatgctgaattgtatgtccccaaaaccaccttgttgcatcactcttccctccttttacataagtagctagccttgcctggaacagcattttttcccgctctggaaataaactcttatcctttaaaactgaggtattacttatttcaggcaacctttcctttttcccctggattgctttggtacccttgtgcctagtatatctccttttactacagtgcagcatgcaatataattatttgtatgtgaggagttcccctccccatctccaac

SEQ ID NO: 77302 - DNA, 601 bp, Human
ccgaatatgctcatgttagagggggttagtagccaagtttcttagttctcttctttgtttgactggtgagtgagcagaagagggcaaaaaccgaaatcactggagatgttaatggtttgctgaataaatagacattaagtaattgctgtaagtaagaggcggtgctactgacaaagtcagataggacctagccctagcttccccagttaaatactgtcaagcgtgatctgccctctgcttccttctgtagttttatatttggggctttgactgacaatgctgaattgtatgtccccaaaaycaccttgttgcatcactcttccctccttttacataagtagctagccttgcctggaacagcattttttcccgctctggaaataaactcttatcctttaaaactgaggtattacttatttcaggcaacctttcctttttcccctggattgctttggtacccttgtgcctagtatatctccttttactacagtgcagcatgcaatataattatttgtatgtgaggagttcccctccccatctccaacttcttgacagggactcatttatttatttatttataagagacaaggtcttgctctgt

SEQ ID NO: 77303 - DNA, 601 bp, Human
tacccttgtgcctagtatatctccttttactacagtgcagcatgcaatataattatttgtatgtgaggagttcccctccccatctccaacttcttgacagggactcatttatttatttatttataagagacaaggtcttgctctgttgcccaggctggagtgcagtggcctaatcatagctcactgcagcctcgagctcctgggttcaagcagtcctcccacctcatcctccctagtagctgggactacaggtgtgcaccaccacacctgactatttttggtagagatgggggtctcactrtgttgcctgggctggtcttgaactcgtgacctcaagtgatcccccggccttggccttccagattactggaattacagatacgagccaccctacctggcccgcttttttttttttttttttttagtgcctttatctttgtttctttagagctcagaacagtgagtgatgtaggtagtcagtgtatcttaagtgaatagtcagtgttttgttttgatgggttaaaggtgaaattggctaactggatatttaaatttccctggtactctcaacaaataaaagtgaaaattatgtactaaaata

SEQ ID NO: 77304 - DNA, 601 bp, Human
agtagttaaagtaggaagagctcagacacttgattcataataataccataagggaaacacactactttgctggagaaaacaaaacatttctcatcatttagccctgaaagaaagttttcaagtgaaattattgagtcttttaatgaatgctaaaggcacaacaccaaagctattgaggaaattcattccttcaggggaaagacagatctgccaaaggaattgaactgactgtatgtctgtcaaacgagtttctgtaaatgattcagccatgtgttttggtgggtttttttgtaattaattwtctttttattgtggtaaaatatacattacaattttgccactctaaccatttttaagtgtataattcagtggcattaagtaccttcacattgttctgcagccatcaccgttgtccatttctggaacttgtttaccatccaaaagtgaaattttttgcccattaaacaataattttccattaaacaataattttacaattaaacattaaacaataattttccattccttcctccacctaactaacccctggtaaccactagtctacatgtctatgaatttgaccgtgcataatacctcatgt

SEQ ID NO: 77305 - DNA, 601 bp, Human
ttgtagcatgtgtcagaatttcctttttatgactgaataatattccattatatggatataccacattctaatccatttgcctcttggtggacactgggttgcttccctctttggactgtagtaaataatgctgctgtgaacatgggtatacgaatgtctgttccagtcactgctttcagctctttggggtatatacccagaagtggaattactggattactggtaattctatgtttaattttttaaggaggccaagcgtggtggctcatgcctgtaatcccagcactttgggaggctgagrcagcagattgcttgagcccaggagtttgagaccagcctgggcaacatagtgaaactgcatctctacaaaaaaaatacaaaaactagctaggcatgatggtgtgggcagctatattcccagctactcaggaagctgagttgggaggattacctgagcctggggaggttgaagctgcagtgagctgtgatcactgcactctagcctggatgacagagaaatttttttttttcttttgagtaactgtcacactattttccacagcagctacgtggttttacatacccaccagcaatgcacaac

SEQ ID NO: 77306 - DNA, 601 bp, Human
ttggtggacactgggttgcttccctctttggactgtagtaaataatgctgctgtgaacatgggtatacgaatgtctgttccagtcactgctttcagctctttggggtatatacccagaagtggaattactggattactggtaattctatgtttaattttttaaggaggccaagcgtggtggctcatgcctgtaatcccagcactttgggaggctgaggcagcagattgcttgagcccaggagtttgagaccagcctgggcaacatagtgaaactgcatctctacaaaaaaaatacaaaaaytagctaggcatgatggtgtgggcagctatattcccagctactcaggaagctgagttgggaggattacctgagcctggggaggttgaagctgcagtgagctgtgatcactgcactctagcctggatgacagagaaatttttttttttcttttgagtaactgtcacactattttccacagcagctacgtggttttacatacccaccagcaatgcacaacggttccagtttctccacatcctcaccaacacttgttattttctatgggtgtttataaaatagttattctaatgggtgtgaagt

SEQ ID NO: 77307 - DNA, 601 bp, Human
aaggcacagcaaaaaggccagagcagattgagttaagggacgaatgacagaaagttaggttaaaatggcggccatagagagcctgttaagtgatggtgaagaacatgatagaaagtatttggaacattattgtgtaatttagaaatgttaaatgttgtaattactttttacaaaaaattagttgctcttaatacattatttcttatagctgttacatacaaactgtctcaacaacctcgtatatttcagacaaaactatatcatctggataatggagattactttttgttgtctataagaragggagtaacatccagtagtagtgttcattaccatgtttttcatgccttatgaaacatcctattttaatccttattgttaagccctatttttcttttccttttccacgtgcctaattgtgaaggaaacctccctctctcccatcactccttagttccttctctgagtcccaagtggcattgattgtgatttttcttttaattacaagtagagcttgttacctatatgtagaaggaaagctaaacattttgatataaaattagaaataattcaccaaaataactgtaggtaaagtaagaag

SEQ ID NO: 77308 - DNA, 601 bp, Human
tccttttccacgtgcctaattgtgaaggaaacctccctctctcccatcactccttagttccttctctgagtcccaagtggcattgattgtgatttttcttttaattacaagtagagcttgttacctatatgtagaaggaaagctaaacattttgatataaaattagaaataattcaccaaaataactgtaggtaaagtaagaagagctcagacattcgattcataataataccataagggaaacacactactttgctgtagttcaccaaaatagctgtaaaggtcactgttaactatttamctttctcttaagaacttgtttttccctgtttattagtacataattaaaaattcttattcaggcccagatgtgatagcttatgcctgtaatcccagcactttgggaggccaaggcaggaggatcacttgaaggcagaaattcaagaccagcttgggcaatatagcaagatctcatctctacagaaaaaattgtttcgaagtagccaggctttgtggcacatgcctttagtcctagctgctcaggagattgaggcaggaggagcccaggtgttcaaggttttggtcagctatgattgtgcca

SEQ ID NO: 77309 - DNA, 601 bp, Human
catcattgttttaatcttataaaatatctttaagctgaactttcccaagagtccgaaggagtcgcagcacttccttttttaacctctagtggtgtaaataatggtgtgtcattccggttgactagtacattctaggtttaaacagctgagtttgggctacttgttgcttgacttactgaagcagcttgcttaaatattgccctgattgggcataggtgaacataggttattagtaggagcaggtttatgctgaaggaagtcagccacattatgcatgcataaaaattgccattattgatayagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaa

SEQ ID NO: 77310 - DNA, 601 bp, Human
caggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaamaaaaaaacttatgtccgattccttttggtttacaggcagaaatttacaggtagacacatttctttcttgtactatcgatgcttattgatactgatgctggaattttattcttccattatagttttatatttgaataggtgctttttaacaattttgttttccttaaccggttaccttacttttttaagactggacccaattacttgttgagcactttatgaattaattttgttagttttaattatttcacttctgagacttcttagcatgtgatgtgtgttttccttttatcacctggaa

SEQ ID NO: 77311 - DNA, 601 bp, Human
cctcaccattatgcagtatatccatgtaacaaacttgcacatgtacccctgaatccataataaaatatatgtatgtaaataaaaattaaaaaataaaaccatgaacaaaataagtgtaggctgtttattctggtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacaggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattatt

SEQ ID NO: 77312 - DNA, 601 bp, Human
gtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacwggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattattatttttgagatggagtcttgctctgtcgcccaggctggagtgcagtggcatgatctcagttcactgcagcctccgcctcccaggttcaagtgattctcctgcctcagcctcccaagcagctgggattacagg

SEQ ID NO: 77313 - DNA, 601 bp, Human
actttaattgttgttaagagaatattagaagtgtttactataaatatcttgaaatatttgggaaatattttggtttatttcagataaactgctagtgtatgtttggaatacgttaaatgcataaacttactgctttatattttctttttttttggagacggagtcttcgctttgtctcgcccaggctggagtgcagtggtgtgatctcagctcactgcaacctctgcctcctgggttcaagcgactctcctgcctctgcctcctgattagctgggactacaggtgcatgccaccacgcccrgctaattttttgtatttttagtagagatggggtttcaccgtgttagccaggatggtctccatctcctgacctcgtgatccgcccgcctctgcctcccaaagtgctgggatgacaggtgtgagctactatgcccggcgctttatattctttagtaatttctggccattgtggctccttaagcttgttaattaatttagtgtccatattcatatcttaatgatactgagaaattggttaaattggtttttggtgtctgtctcttgcttatgaaagataaactgtagttcagctatttattag

SEQ ID NO: 77314 - DNA, 601 bp, Human
aggagctgggcacggtggctcacacctgtaatccagcactttgggaggccaaggcgggcagatcacctgaggtcaggagttcgagaccagcctgaccaacatggagaaaccccatctctactaaaaatacaaaattagccgggtgtggtgacgcatgcctgttatcccagctacttgggaggctgaggcaggagaatcgcttgaacccgggaggcggaggttgcggtgagctgagattgcgccattgcattccagcctgggcaataagagcaaaactccatctcaaaaaaaaaaaagttckttaaagaagtttagtttcgtatattgactaagctatagggggaaaagccttactgtgccttttccacttcctacccactcaagataacctaagttggcttcctttatttaaagtgttaaatctactctagagcataccaaagatattttgaaaatataggaaattcttaatgcatttaaaaggaactacttcccaatcagtttttttcccatcatagaagtaatgtatactcagagatatcttaaaaaacaaggaaaaataaaaaccaaaataaccccactgaagtttcatcactaaaag

SEQ ID NO: 77315 - DNA, 601 bp, Human
gcccttgtgaaacttatgtttcagtgggatcataggtgtatgtttgcaattttatatcctgaaaattttataattcagtataacataagaattagtataaatatttttaatagctgcttgacagttccttatgtgcatatgccataatttccttcatttccccacagtgttaagtatgttatttttgctattgtaaatatagtgggcgagggtcttactccacaaggttgtaaccatgaaataatatttctgttttatgaaaaccaaatttaatctgtgttgtatccttacctaattgagwtggccattatttccctgcacaaatccccctccctctaatccttggtgagcttcttacattccagaactttatcaggaaagggctttcctccagtctttcacctacaccgcttgtcattgacatgcccatttatgtaagtctggaaggtttctttaaggcctcgttacagagaatattgggtaataggatctttgcacaattttccgaaggaaagtttttaccattattgtctctcccttctccctgcagctcccaaggagggtgagtgtattgatcttttctggatgaatcctctaatcc

SEQ ID NO: 77316 - DNA, 601 bp, Human
attgtatttcctcttttgtcttttgttatatttttgccttcaggtgcttttctcccctaaccagttttcataagttccttatatcagaatgaatccttttatattttctgcaaatatttttcaatgccgagaatttaatgtcaatagtatatcactgtttataccatcaaattggttagtcatcttaattctgtttttctttttttcatttaagtatagtgaatctttgaacttgataggtgaatttctggttttttatcttcttgatattggtgtttaaaatggatttatcttcatggawatatttatgttatagtattaaaatctgaaattgaacttagtatacaaaaaatagatttttaaaatgtttatactagctccttatcaatgtttaaaattttgcttttgcagttacaataatggttattcccttatttctgtatttactagtagagagtaaattaagacattactgaatacaatgagataaatggcttatcaagtaatagtctttcttgtaacacaaatgagttcttagatcagttgtctttaaatttgtcttgttatggcaagttgtgttttcagtggcaactttttttag

SEQ ID NO: 77317 - DNA, 601 bp, Human
cgtaaagtttgatcagaagtttgacgtgtaatcccagcactttgggaggccaaagccagagaggatcacttaaggccaagaatttgagaccagcctgagcaacatagcaagacctcatctctgcaaaaaaaaattaacatattagctgagtgaggtggtacatgcctggagtcctagctatagttcaaggctgcagtgagctatggtcgtgccactctactctagcctgggcaatagagcaacaccttgtctcaaaaaaaagtttgagctatgtatgtttgaagggcttgtgttctcaaawtggtgagaaaagggtggcgatttgatactatttatgaaccagacactgtgttttatatatattctcttttattcttgtgtcatatattcttatgtcacctgaatgaggtatcagtcccattttacagggtgaagagactgaaatgaagtaatttgccaagcttgtgttcaacaaacgtagaagtggcagtggagcctagatcattcttgtttgtttgtttttcatttttgttttaaaagctgagcatgcttctcttcaaactttatgattaccttgtagtgcacgttaaaactaatagct

SEQ ID NO: 77318 - DNA, 601 bp, Human
tttctttttttctgagacggagtctcaccctgtcacccaggctagagtgcagtggcgccatcttggctcactgcaacctccacctcccgggttcaagcagttctcctgcctcagccttccgagtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacatgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatct

SEQ ID NO: 77319 - DNA, 601 bp, Human
gtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacrtgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctg

SEQ ID NO: 77320 - DNA, 601 bp, Human
accaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctrcttttctccaaaacagttgaataatgtactcattttcataaaattttagaaaaattagtgagtaaatttttggcagttattttatttgacatgtgagtggtatttgctttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctgga

SEQ ID NO: 77321 - DNA, 601 bp, Human
ttacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctacttttctccaaaacagttgaataatgtactcattttcataaaattttagaaaaattagtgagtaaatttttggcagttattttatttgacatgtgagtggtatttgcyttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctccgcctcctgagttcaagtgattctcctgtctcagcctcctgagtagctggaattacaggtgcgcgccgcacctg

SEQ ID NO: 77322 - DNA, 601 bp, Human
attctcttctgttaaaattgccactaattatgtgttttttctaaatcatattgtctacttttctccaaaacagttgaataatgtactcattttcataaaattttagaaaaattagtgagtaaatttttggcagttattttatttgacatgtgagtggtatttgctttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctccgcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcatgagccaccgcgcctgg

SEQ ID NO: 77323 - DNA, 601 bp, Human
ttcataaaattttagaaaaattagtgagtaaatttttggcagttattttatttgacatgtgagtggtatttgctttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctcygcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcatgagccaccgcgcctggctcctttcccttaattttctgaaagaaaaattcacatacagccgtgtgaattgactggactgtgaaattaaaataatggatttttttggtc

SEQ ID NO: 77324 - DNA, 601 bp, Human
ctttcttttcttttctgtttttttttttcttttttttttttgagacatagtttcactttgtagcccgggctggagtgcagtggcacgatctgggctcactgcaacctccgcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcrtgagccaccgcgcctggctcctttcccttaattttctgaaagaaaaattcacatacagccgtgtgaattgactggactgtgaaattaaaataatggatttttttggtctttatactgcaagtttgagaaataaagaacaaagcattttctctgtggatgcgaagaactctgtacttgactcagcttcctttttctcttgcctgcattttttgtttacttcactggcttgattagtcataataaggctcagtacctctgccattcccaatgttaagcaattttttaaaatttggaattttg

SEQ ID NO: 77325 - DNA, 601 bp, Human
acttttcttctaagtttagacagatgatagaaattcacaaaaatttcagtcatagttatggccacagttaggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaarttctgaattaatacttacatgctgaagtatctttgtggagcttattttgagcgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggc

SEQ ID NO: 77326 - DNA, 601 bp, Human
aggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaaattctgaattaatacttacatgctgaagtatctttgtggagcttattttgagcgttagagtgggagactkagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaa

SEQ ID NO: 77327 - DNA, 601 bp, Human
tacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtacygctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttctt

SEQ ID NO: 77328 - DNA, 601 bp, Human
gacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctrtgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcg

SEQ ID NO: 77329 - DNA, 601 bp, Human
ggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgygattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatt

SEQ ID NO: 77330 - DNA, 601 bp, Human
tttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctmattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaa

SEQ ID NO: 77331 - DNA, 601 bp, Human
gtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacwtaaagtcagctgattgtaggtttaaccatatctacaaaaatacctttatagcaacacctagttagtatttgatagaataattgaatactgtagcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatacttatactctgctaacatgagatcaacttatgcactaatggaccatat

SEQ ID NO: 77332 - DNA, 601 bp, Human
aatgaaagtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcggggggraaaaaaaaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttagcccataattttcagagaaagtagttgtttgttgat

SEQ ID NO: 77333 - DNA, 601 bp, Human
agtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcggggggaaaaaaraaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttagcccataattttcagagaaagtagttgtttgttgatggcacc

SEQ ID NO: 77334 - DNA, 601 bp, Human
gtctgggtgacagagcaagactctgtctcggggggaaaaaaaaaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttakcccataattttcagagaaagtagttgtttgttgatggcaccaaacagggctcctgatttatgataaagaatcataaatttggtaaaagttacagtctgaagtacaaaaccccaatgattttccattctagtgcttcagtgagaagcttaacagtgtactatgtataggtagataagaataaagtaaaagacagaattctttgctgttaaaatgaaagaataacttttacttagcatagtatggtagtatactaataaatggtacacactgctagtcataaaatttagattttgtccccag

SEQ ID NO: 77335 - DNA, 601 bp, Human
taattatcttggttatacctaaacattgctactcccctacgctagccccgcaaaagtgagagagcttgtcaaggcaaagttttttgaaggaagaagccacatgaaatgagagagggaaataatgtatactgtgagcttaggaagagcaaaggtataaaggtgatagagagattggcacagaactacagtagtatatgtattagttctgattaataaatgtttcaatttttatgatactgttattctttttttttttttttttttttgaggcggagtctcactgtgtcacccaggctggagygcagtggtgcaatctcggctcactgcaacctccacttcccagcctcaagtgattctccctgcctcagcctcctgagtagctgggactacaggcacccgccaccacgcccagctaatttttttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatat

SEQ ID NO: 77336 - DNA, 601 bp, Human
ttcttctcactatatgtatattcttgtctggccctgagacagaacactggattagaagcactataggttgactaaatatggcagttcttaaatctatatgatgatagtttgcattattttattgttaacttaccatttgcatttttataaacagctttattgagataattcacatactatacaattcacttggttaaaatatacaattcagtggtttttaaagtatattcagaattgtgcaaccatcacagtactaagttttagaacattttaatcacttcctccaaaaaaaaagaaaacyccatttcccctcaactcttccagttgtgtggataaccactaacctactatgtctctagatttgcctattctggacattttatataagtggaaccatataatatgtgatctcttgtgactggcttttttcactcagtgtaatgtttttaatgttcatccatgttatagcatggatcagcacttcatttttatggttgagtaattaatatttgattgtatggagataccattgtgtttattcatcagttgattgacatttgtgttgtttcccgttttgggttattatgaataatgctgctat

SEQ ID NO: 77337 - DNA, 601 bp, Human
ctgccttggcctcctgaagagctaggattacagtcatgagctaccatgcctggccaagatactgtcctttagtttccttgtgatgtttctatctggcattggtgttaggttaatactggcctcatagaattcctcttatattttttggaagaatttgtgaataattgatgtcaattatttaagtgttttatagaactcatcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctggaggtaattgaatcatgggggccgtttcctccatactgttctcatgatagtgaataagtctcagagatctgatggtttgataaggggaaactgttttgcttggttggttctcattctctgtctgccaccattgatgtaagacatgacttgctcctccttgccttctgccacgattctgaggcctccc

SEQ ID NO: 77338 - DNA, 601 bp, Human
gtgctgggattacaggcatgagccaccgcacccggcctgcatgtctgtcattttaagagtttcttctgattttctcacccctaatcattttctcttcttgctttatattacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttrtttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaag

SEQ ID NO: 77339 - DNA, 601 bp, Human
ttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaagttaattaggcacagtggtgcgcacccatagtcccagctacttgggaggctgagacggtaggattgcttgagcctgggaggttaaggctgcaatggtctaggactggactactgcactccagtctgggcaacagagtaagaccctctgtcaaaaaaaaawtttttttaaactgaatatttatttggactgaaagaagaaatgacaacaaattataaagttaaaagaagtcatatcaaaaaatcacaaaatccagaaaaaaacatttattaagtaccagacacatcctacttttgcttttccttcattttttggcttcatcttctttgatcacctttttatttggcagtgagtttataatactttatatatagaaaataaaaagatcatatagctttcctctagcattcaggtttttttgctatatgggtgttaataatttttattttaattgcctgctat

SEQ ID NO: 77340 - DNA, 601 bp, Human
tctccctagtaacatctccctgcctcccctgtcctgaattttacatttcattttattgtcttaagtgccaagggcaaggtttgtcaaaatcaagtaatgttcagcctttttggtagtgaaatatacataacataaatttaccattgtaaccatttacaagtaacttagaagtatacagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctaccaaagtgttgggattacaggcgtgagccaccgtgcctggccccaaaccgaaactcttagctcttaaaaactgagtccccattgtcccctttccctggtccctggcaaccttttttctactttctg

SEQ ID NO: 77341 - DNA, 601 bp, Human
acagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctmccaaagtgttgggattacaggcgtgagccaccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatatatataattaatattt

SEQ ID NO: 77342 - DNA, 601 bp, Human
gttgtttttggaaagtattgagaaataagctggatccaagggactttggaatttggatttgatgtaatggagcattttccaaacttgctggtcataagaaatcccttccttggagactggggccagggtcctagaatcctttcgtaacaagtgcccctgaagattcttgtacttcagcaaagttggttaattatgcatttactatttttgagcaaggagcttggtgtcataaaaatagtgtctgggggaatatctttatctaaagggtaggttgaagggtaaagagagtcatcaggcaatktttattttgatatgacgtagttgtggcttttattagtttgtgaccatggaaatgagatatggggaatcatggaattatagagattgcctgggaagacaaagggaaatagggaatgagtgatttgtggagagactttataggcttggacatatattgagtctttgctcataaaatgtcgtagatatttggaaatctaatttgaattccagaattagtaaaacattacacttaagtcagaccttgccaggcataaagatattgtatatttttatgtacatgctcaatatcgtatattctcaa

SEQ ID NO: 77343 - DNA, 601 bp, Human
gctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatt

SEQ ID NO: 77344 - DNA, 601 bp, Human
caaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatrtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttct

SEQ ID NO: 77345 - DNA, 601 bp, Human
caaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgmtgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggcccggcacggtggctcacgtctgtaatcccagcactttgggtggctgagatgggca

SEQ ID NO: 77346 - DNA, 601 bp, Human
tttttaagaagagttagttacctacagttaatacttctgtcatctttgaattgatgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccsggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagccgagattgtgtcactgcactccagcctgtgcgacagagcaagactccgtctcaaaaaaaaaaaaggtgaaatagatgccc

SEQ ID NO: 77347 - DNA, 601 bp, Human
taatacccaacaacaattagtatcactttaaaagataaaatagaggcccggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagccgagattgtgtcactgcactccagcctgtgcracagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaa

SEQ ID NO: 77348 - DNA, 601 bp, Human
ccagataattttggggatacagttgttagctgtaaagtaaaaatttcaagtttaatgaatgaaaactagtctcactgctccattagcacaattggtttggaaggtttgcttctgggcaaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaaraaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaat

SEQ ID NO: 77349 - DNA, 601 bp, Human
aggggaaaagacatttatggaattcattcaacaaatggctgttgaacaagtcactatgctaggttgtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcracagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtat

SEQ ID NO: 77350 - DNA, 601 bp, Human
gtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcgacagagtgagaaccttaaagttcaattaataattgatgtaataactgaagagaaaaattaatgarcaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtatttaagttattgcttaaaagaaaaaaaaaattaggcttcatgcagtggctcacacctgtaatccca

SEQ ID NO: 77351 - DNA, 601 bp, Human
attacattccttattgggtacttttggcgacagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaatttycctgacttgaagacaaatacttgagtatttaagttattgcttaaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcat

SEQ ID NO: 77352 - DNA, 601 bp, Human
aaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcattccagccttggtcacagagtgacttcctgtcttttaaacaaayaaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacacc

SEQ ID NO: 77353 - DNA, 601 bp, Human
gagaagttatggccgagtgtggtggctcatgcctgtaatcccagcactttgggaggccggggcaggcggatcacctgaggttggatcacctgaggtcaggagttcgagaccagcctggccaacatggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattccagcctaggtgagactctgtctccaaaaaaaaaaaaaaagagtggctaaggaatcagaaatcaaatgtcaaggtagccctctagtggttaaaatgagattaaggtttattgagaaactacctatttttttcatttgtattgtgctttgctatatccctgcaacttttatatcagatgcagattatattgtgacagttatcacttaaaaaatacttttagttccatttcccataacatcagaaattaatccccaaatagctagatctatcattcctttcacagaaataggtttaatgcagaaatttcccgttacttattgtaaaga

SEQ ID NO: 77354 - DNA, 601 bp, Human
atggtttacttgttttaaaaactatattgaggagctttgggtaacatagtggggtaataagcccctgtggaatggctgtcccacaccaacaaactgaaatgtggaatataataaaagttttttccaatacgtgtctaagctttaaggaaagaaaggttaacctccagataataagcagagataactcaaagccaaaacaggaacttatactctgggattttagaccacatattggttgaggagttgatgctagttttaatgtccatgcaaggacagaaagccttagaactaggtagagagrggagctagaacttagcctgtgtcaaaaaactgaactatccgtgaaaagagagacctcagtgctctagccagtgaaagctgcaaggaattttacctgtgtgcagaagactgtggataagaggggagacctatgaaaaatagaaattcacatcaaatgctaccagtgttcttaattattctgtaaactaatcttttctttttctttttttggagacagggtctcactcggttgcccaggacagagtgcagcagcacaatcatagctcactgcagcctcaaactcctgggctcagggaatcct

SEQ ID NO: 77355 - DNA, 601 bp, Human
caattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaagagaaaagaaggaattgaaggaaaaagacaccaaagaaaaaaaagacaggcataatttaaaagcttctgaagaacttctagaaataagaacattaaaattcaaacataaatggtctaacggttaaacagcagactgaaytgaattgacaggaatattaactacgaagaaatgagcaacagaacgcacaaaaaagacagaaaatatttaaagaggatgacatagtagtgagaagacccagatagatttaattatctaaaaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttc

SEQ ID NO: 77356 - DNA, 601 bp, Human
aaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcrgattgggaaggaatgggaattaattccaaaatgcatgctttttggacctttcgagtttctacctttgttctctatgtatatttacattgaaacagataaaacacccatagctgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaa

SEQ ID NO: 77357 - DNA, 601 bp, Human
ctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcggattgggaaggaatgggaattaattccaaaatgcrtgctttttggacctttcgagtttctacctttgttctctatgtatatttacattgaaacagataaaacacccatagctgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaaaattagctgggcatgatggcgggcgcctgtaccca

SEQ ID NO: 77358 - DNA, 601 bp, Human
ctttgctcattttttattggattgcttgtttttttgttgatttattagagttctttatatattttagaaattagacccttgtccagatccatgatatgcagatattttctcctataggttgccttttttgctccttgataatgttctatgatgtacagattgagtatagtatctcttatccgaaatgcttgggaccagaagggctttgaattttttcagatattggaactttgaattatacttaccagttaagcctcccaaatctgaactccaaaatgttcaaatgagcatttttgttgtrtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtgtatgccgtgaggtagggtctgatt

SEQ ID NO: 77359 - DNA, 601 bp, Human
tgttcaaatgagcatttttgttgtgtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtrtatgccgtgaggtagggtctgatttcattcttttacatgttgatgtccagttatcccagcatcatttgttgaagagacttttacctattgaatggtcttggtactcttctcaaaaattatttaatcatatgtataggtttatttctggactctcaattctatttcattggcctacatgtctgttcttatgccagtaccgcattgctctgattactatagtaatttttgtaaattttgaaaattagaagtgacttctccaattttgttcttctttttcactattgtttttgacagttgggg

SEQ ID NO: 77360 - DNA, 601 bp, Human
cattttgtatagtatcaccatctttaactatattgtcttctaatccgtgaacacagggtgtctgtccatttatttatgtcttttttaatttctttcagcaatgttttgtagtttcattatacaagtctttcacatccttggttaaatttattcctagatcctttatatgctattgcaaatgaaattgttttcttaatttccttttcagattgttaattgctggtatatataaatacaactgatttttgtgtgtcagtcttgtacttttgtaactttactgaattcttgtattagctcatcggtgtgtgtgttcattctttggggtttttttttttttttttttttttaaacagatggggtttcactctgtcaccgaggctggagtgcagtggtgcagtcatagctcactacagacttgaactctaggcttaaaggatcctcccacctcagcctcctgagtagctgggactccaggtgtgtaccaccatgcctggctaatttttaaatttttcataaagatagggtctcaatatattgcttatggtagtcacaaattcctggcctcaagtgatctcccttgcctctggctcccaaagtgctg

SEQ ID NO: 77361 - DNA, 601 bp, Human
tataatattgttcaagtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactrttagcatagaatatcatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctc

SEQ ID NO: 77362 - DNA, 601 bp, Human
gtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactattagcatagaatatsatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctcagctcactgcaaccc

SEQ ID NO: 77363 - DNA, 601 bp, Human
cacattcctagagacagtcttgtactgttttttgctccttatctccttcattactacctttttaaatgtatttatttttcttttgtagtataccattttcattcctttctcatttccttttgtgtatatatttagatattttttcagtggttaccttgaggatcacaattaacatcataaacctccaacagtctaccctgaattgataccaacttagctttaatacagcatacaaatctctgatcctatacagcctcactcctccttcccattttatgttttcattgtctcaaattttatstttatacattgtgtacccattagcatagttttataatcattattttacatgcatttgtcttttaaatcatgtaggaaataaaaggaattataaaccaaaaatacattaatactggttttaatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttca

SEQ ID NO: 77364 - DNA, 601 bp, Human
taatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccstctatggtttttgctgaaaaatcagctcataatcttattgaggatcccatggtcataagtcacttctcccttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttctttatctaggactcccattgtgtatattttgctca

SEQ ID NO: 77365 - DNA, 601 bp, Human
tgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccctctatggtttttgctgaaaaatcagctcataatcttattgaggatcccatggtcataagtcacttctccyttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttctttatctaggactcccattgtgtatattttgctcaacttgatggtgtcccacagatctcttagactctgctcatttctgctcctcagactgtacagtttcacttc

SEQ ID NO: 77366 - DNA, 601 bp, Human
taaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaacyataaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacata

SEQ ID NO: 77367 - DNA, 601 bp, Human
aaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaaccrtaaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataa

SEQ ID NO: 77368 - DNA, 601 bp, Human
tatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctsacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgagatggagtctctctctgtcacccaggctagagtgcagtggcacaatctcagctcact

SEQ ID NO: 77369 - DNA, 601 bp, Human
gcaaccctgaagcgggcttcttttgccaagagtgtgataggtatgtttcaggtgtaccttggagcctgactggctttctgacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagcctttttttttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtgatccacctgccttggcctcctaaagtgttgggattacaggcgtgagccaccccgcccag

SEQ ID NO: 77370 - DNA, 601 bp, Human
ctcctaacattttgtgaaaataaatatgacaattcattctgaaaagttggttttatcaacttttttcttagtctcactcttcagaatttatgatctatctaaaagagtgtttctcaacctcaatactactgagatttggggttggacaattctttgttgcaaggggctgtcttgtacgttgtaagactctggggcagcattcccagcctctacccactagataccagtagcacgctccctctgtacctgccttctagttgttataaccaaaagtgtgtccagacattgctatatatggccmctagaagacaaaattgccccctgttgagaatcacttatctaaagaacaaggctgtccctttcagactttatatgttagaaactcaaagctggaaaaataatttaatgcctattttgataagctttcactctatgaagaggatatcacaatttaaaaacttgaggtcttcataaacattctatttactccctccaaaaggtgacaataacaaaagaaacccattaatttttaagtgaacttggatactgagtattactaggaaaaacacagaacaccagttatttgtacatctttcaaaaa

SEQ ID NO: 77371 - DNA, 601 bp, Human
atgtattgaatatcgggtttttcactgcaaggccttcttaaaaagtgaaactaattagattgagtgttaatgccaagagtgtagctgtaaatattaaccctacagctaccatacattagtgggcacacaagtattttgatctttttaaacccatcatcttatcttacagatgtaccattatatttgctttgttccttgcatagtgtctttccttttccttctatttgttttcaatatgaattatattagtttattatcttagccaaggttttattttggcatattgtataaagaaattcawtttacacagtaaatcaataaatagatccttgaccttattccagtttcatataaaggccttgcagtggaagatcttttatgagatatttgatggaacagactgactgagaagatttccttcctcttttctccccctttccttttttctccccattccaatttcttctctctcacaggtcaacccctctgcttctcaccccggtgagtaacgtctgaagcttctgctcgcattgagtctgaatcgttcttttaatttaaggtaccccagagttcatggcccctgagatgtatgaggagaaat

SEQ ID NO: 77372 - DNA, 601 bp, Human
ttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtgtaagtcttcccctaactgattgttgaacttggggcatatctaacaaagaatcccaaggtggatgacatcaaaccatgtaaaagaggacaatagtggaaggcatactgagtgaactgttggggttgggggggtggtgttgaggtatgtgtaagkctattgctcatgatacagtgaaagataaagatcaaagaaccactagtttatcctgtacccaccttgcattcatttaaatctttattatgtttaaaaacacaccctcattacctactttttaaccccctattaattcagctaaactcctgttgtctcccaccacataggtcagagttaaaagtaatgtttttaattcaagatgctttgtcaaattaatttgttcactgacttttctctgaatgacttgagttgatttattaaatcttatatattagtacctaccatatttaaggcataaat

SEQ ID NO: 77373 - DNA, 601 bp, Human
tgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccrggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttttaatgaattaatatttttaaactttctcaggtttaccatctgccacggtaaatattaatagatg

SEQ ID NO: 77374 - DNA, 601 bp, Human
aataatgttaattttaagagtataaaggggtcctgagacaaaagtttgagaaccactgttcaaaagtcttgataaaatttaggctaaacattttttgcaaggatacttaatatgtggtgctgtatatgttatattgcaccgagaagctcatagtatctcattatttcatttttagtgatgtaatttaattgaattttgatatagaagatgtaattatcaattgcttatttagattttgatagctgaacagaatggaaatgtttatttttaattttttatttatttatttattttttgagayggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccttgtgatctgcccacctctgcctcccaaagtgctggaattacaggcatgagccagaaatgtttattattaaaaactgataggaaacattt

SEQ ID NO: 77375 - DNA, 601 bp, Human
aattatcaattgcttatttagattttgatagctgaacagaatggaaatgtttatttttaattttttatttatttatttattttttgagacggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccytgtgatctgcccacctctgcctcccaaagtgctggaattacaggcatgagccagaaatgtttattattaaaaactgataggaaacattttgctttaggtagaccaaattttacctcttcataaaggcttgggagaaatctttggagtcaaagattaattataattatttattgctgtgaatattccttcaatatccttgttgtatatttgtatgtgattctgttgttgatggatatggagctactttggacaattagtttaatttcatatgaagtttgaggtttcatacccagtaaaaat

SEQ ID NO: 77376 - DNA, 601 bp, Human
tgtctggcctgaggccttactgttaaatttattaacctcttcttaatactcacccagattctaatacacaatataattgtaatccctgaagcactgactctcaatttgggctgaatgggggcaggagaaatttttttatgccttcagatgattctgataagtaccctaatcattattctacatttatgcccttagaaagctcatctgctttgcctttcagagttctgtatcatcattcccagttcatgtctcttattattcccctttcttcccctgatgcgttgtaatttacattctctccttttttttttcctttgagcatagggtcgactgtttattgggtaatttcctcctttattttgtttaaaattgtagaaaacttaagaggtatatttgatttcttgttttttactcgctgcttccactacttccagtttataaggttcttgcttcagaatacctcttcgatgcaagccttcttcattcccattgccacaactctgatttcacatcttccttactgcacaccttgcattatattccagaagtaatttacattgtgaatttatttttttatttcacttaaacttgttgagctttc

SEQ ID NO: 77377 - DNA, 601 bp, Human
caggattcaatgggcttgtgacatggtataatggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgtctatgaaatatgagttgtcatcttcttgggggkgtgtgtagaatgaaagatggcctttaaggatgataaaggcttaaaataacatctatgaaactttgaactgattaggaaataataattgtgaagcagcaccaggcatccagaatcttcctttttagtattgataaacactattatgtaaacaatgaatatattgtttgtacgcgtgtctatgtgtatgcaagtggaaaagggcaaatttttacctattacatacttctttcttgtgaataaccaataataggctgggcctgtaggctcacgcctgtaatcccagcactttgggaagccgag

SEQ ID NO: 77378 - DNA, 601 bp, Human
aggtaggagaatcacttgaacccaggagacagaaattgcagtgagctgagatagcgccattgcactccagcctgggtgacagcaagacttggtctaaaaaaaaaaaaaaattgataactctattagagtgataaggtttgtgtctagaatagatgggagataaagggtgagaagctgaactaggtttattgttacagcacagcaaattcaatcatttctttttgcccgaaatgtatgactaggtactaatacaatctgacttttttattaaaacatgtaatgaagtaattagggaggaaayataagccagtagattcaaaactgaggggaaaaataacaaaagttgtagtggatcaaagtagatttgtagatcaacatgctatatgagtgatattgctaaacagtaacaggtgtttctgttatgtgactcctgagccttaatttcctcatatgattatggtagtcataactgccaggcctactaaggttgcgaaaaacaaatctgttgaaattatataagaaagtacatttgaaaaagttgagaaatatatttgttgtatttgacatataactagattgactctgaaatgtcttctatctc

SEQ ID NO: 77379 - DNA, 601 bp, Human
aaaaatacaaaaattagccatgcgcggtggcgggcgcctgtaatcccagctactagggaggctgaggcaggagagtcacttgaacccgggaggcagaggttgcagtgagccgagatcacgccattgcactcctgcctgggtgacagagtgagaccctgtctaaaaaaaaaaaaaaaaaaaagaaaagaaaagaaaaaagatagaaatttggctgttgggattggccaagactcagcagttgttacgggcatactcctaagttaggttttcagtcttgtctacctgttaagttaggttgcarttagtccacacagactcaaattagaagtacaaagtccttctcgggccatatttagtttgctttaacaacaggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttct

SEQ ID NO: 77380 - DNA, 601 bp, Human
aggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtagtaatattccagtgtgtgtgtgtgtgtgtgtgtgtgtgtatgtataaacacaattgtttagccatttatcgattggtagacatttggactgttcctaccattggctgttgtgaatagagctgctatgaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatc

SEQ ID NO: 77381 - DNA, 601 bp, Human
caacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtagtaatattccagtgtgtgtgtgtgtgtgtgtgtgtgtgtatgtataaacacaattgtttagccatttatcgattggtagacatttggactgttcctaccattggctgttgtgaatagagctgctaygaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatctcttcatattcttgccaatccttgttgttattattattattattattttgagacagaatctcactctgtcacccagactggagtgcagtggcacaatctcggctcactgcagtt

SEQ ID NO: 77382 - DNA, 601 bp, Human
ctcctgggctcaagtgattctcccgcctcagcctcctgagtatctgggaccatggacacacaccaccatgctggctaatttttttgtattttttgtagagacgaggttttgtcatgttgcccaggctggtctagaactcctcagatcaagcggtctgcctgctttggccttccaaagtgctgggattacaggtgtgagccactgtgccagcctgtgtcttctgttcttaaaaggacagcagtcattgggttaaggacccacactgctcctggatgacttcatcttaactaattacttaackaattttttttccaaaaaaattcatattgtaaggtactagagattggaaccacaacatatctttttgagggacacagttcaaccccataacaattcatgggttcattcagcaaatattcaagtctcttctatgttccagactgttttctagatcctagatattgaatattattgttatgtcaaacacagtccctgtctctaaagaacttaccaagggaaggggaacaaacaaataaagcaaacagttacaatacaatagaaaacacttattttagggataggtacttaatgaaagcatgta

SEQ ID NO: 77383 - DNA, 601 bp, Human
gggactgttttaaaagtgggtagctatcatgtatgtcaacacctacagacttaaattttagaaagattatttctgactgcagagtggagaatggatttctgaggaaagactaaatgttgaaaactcagttaaaaaggtattgaagtaatctaagggaaatgactaatagtctgaaataaggagttgtaagagagaaggccaaagtggatggattagagagattttgtttgtgaattagatttgagctaacctcatttgtttttttccacttaacatttatgaaaataaatgctcatgtacrtatatatacttaagatcaaacaatatcaaacctgattgtgaggttaaatatataactttagatttggggactataaaatttataatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaattttttt

SEQ ID NO: 77384 - DNA, 601 bp, Human
aatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaattttttttttttttttttttttaagtagagatggagtttcaccatgttggccatgctgctctcgaactcctgacctcaagtgatccgcccrcctcggcccccaaagtgctgggattacaggtgtgagccaccacacctggcccattctgtcgtattctaaatggagtagcaaactatgcttcttggccaaattcagcctggtgcccatttttgtacagcccatgacataagtatggtttttggttttgtttttaattttttgagagaaagtctcactctgtcaccgaggcttgagtgcagtggtacaatcatagctctctgtagccttgaacttctgggctcaagtgatcctcttgcctcagccttctgaatcgctaggactacagacatg

SEQ ID NO: 77385 - DNA, 601 bp, Human
ttttttgagagaaagtctcactctgtcaccgaggcttgagtgcagtggtacaatcatagctctctgtagccttgaacttctgggctcaagtgatcctcttgcctcagccttctgaatcgctaggactacagacatgtgccaccatgtccagcttttttttttttttgtagaggtggggtctcactatgttgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatacagcctacaatatttactattaggcccttaacaggaaaatttacttactcctgtgttaaacatatgtcaccagaactttgtaaaacatgttcccctgtagagtcctgtaaga

SEQ ID NO: 77386 - DNA, 601 bp, Human
tgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatayagcctacaatatttactattaggcccttaacaggaaaatttacttactcctgtgttaaacatatgtcaccagaactttgtaaaacatgttcccctgtagagtcctgtaagaaattactgatctacgaaagtagtggtgatgttcttctataagaatgcgttagcctctgtatttgtaaagacatgagaatcttggtgcaaacaagtagctacttaacaggtcagaaaatgtgtaggcagtcttttctctctgttaagagtagaactaaaactttaacatttttatttgccaaatgcaaac

SEQ ID NO: 77387 - DNA, 601 bp, Human
tcatccccaaaatgaagccccataccagttagcagtcatttcccattctcctctccaacccatcccctagcgaccactaatctgctttctgtctctggatttgattttcctattctaggtatttcatgtaaatggaattatacaataagtggcattttgtgtctggcttctttcacttagcaaaatgtttgcaaggtacatccatgtggtagcatgtatcagtactttttaatagttaaataatattctattgcatatatatactacattttgttctattcagcaggttttatttcccttwagttctttagtttcttcctctttttctcaatgttaaactgcttgactctatagctgcctcttaatctggagagagattgagaacaatgttttagtccatttgggctgctatatcaaaaatgccataaactaggtggcatataaacaacaaccatttatttctcacagttctgaaggctggaaagcccaagatcaggtgccatcagatttggtatctagtgaggttctgttcctcatagaccggactttctcgtgtcattttcacatggtgaaagagtcaaaaagctccctccggactcat

SEQ ID NO: 77388 - DNA, 601 bp, Human
gctatgaaaatttagttgtgtatgctctacagtccttaattctgcactgtccattaccatacttcttgcctaggaaatactgtctagattttaccaatctccattcccatcttctggcttctagtaaagaataaaaagggctgtggtctttgttactttcctaaaagttttcttatgttttgggtgctgagataaatgtggagggtttaaataagttcttagataatataatttatataattatataagcaatcatgatgattctgtgttgaaataggccttgaaatattgtaccttctcctttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccgg

SEQ ID NO: 77389 - DNA, 601 bp, Human
ttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcstgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaag

SEQ ID NO: 77390 - DNA, 601 bp, Human
cgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttraaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagtt

SEQ ID NO: 77391 - DNA, 601 bp, Human
ggttctgttaacatgatactaatacaaacattaacattattttcctttacctcttttttgttttgtttttaacctgttttctagaccgcaaggaaaactgagggtaaaaagtttaggagatgtgagtaacaaaagtctggtactgcagttttgagctctgagtaaaggttcattccccctatttaacagagaaaaacttattaattgtatgctatacttgtagtcttgacccagttgtcatgaaagtctatgccactgataatgagaagatccaagtaaaagtaggaatatatttagcacmactttggtgtgcttttaaaataataaaaaccgtagcaggcaatgatatcaactttttatatgaaggatagtgcgtttgaactggagcagtacacaagctttcatgtattcagagagtaacgagccttggggaatcgtgagtaagttaatttctttgatagagctagcttgatttggtagggagttcaaagaggcttgttttccaatgggatcatagggtatgttcaaattcctgtaaactaatggttcataactgtaagaatctggctgaatccagccctataacaaccaagttagaaat

SEQ ID NO: 77392 - DNA, 601 bp, Human
cacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctsttcactctgatggtagtttcttttgctgtgcagaagctctttagtttaattagatcccatttgtcaattttggctttttttgccattgcttttggtgttttagacatgaagtccttacccatgcctatgtcctgaatggtactgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagg

SEQ ID NO: 77393 - DNA, 601 bp, Human
cttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttttttgccattgcttttggtgttttagacatgaagtccttacccatgcctatgtcctgaatggtamtgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagggaatcctttccctatttcttgtttttgtcaggtttgtcaaagatcagatggttgtagatatgtggtgttacttctgagggctctgttctgttccattggtctatatctctgttttggtaccagtaccatgctgttttggtta

SEQ ID NO: 77394 - DNA, 601 bp, Human
ctgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagtaaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacacagtatataga

SEQ ID NO: 77395 - DNA, 601 bp, Human
aactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacayagtatatagaattcaaatgagaagtcagcctataaaatgtgcatatgtttttgtggggtttttttagttcaaataatacaacataaaatttgataaacatttgtcttatatcggactctcaatgtgctattatagagttacagttgttcatttttttgtaccccatttaaaattgtgcagaagtggcctttgtgttttgtaatgagtgtacaatagatattcaagaaatacttatatttaatgaagaaaaataagctactgtcccatgtcaaaaaacatatgacactactgcctaaagat

SEQ ID NO: 77396 - DNA, 601 bp, Human
ttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgckcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacac

SEQ ID NO: 77397 - DNA, 601 bp, Human
gctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacarttccttgctgtgaaaagttagccctgggagtagaattctccaaaatgggtcttcggaataatacaatgagtaattgagcattatccagctttggatataactcttgtacttaaaagactttagagcttatcattttatgtatttcatttatttcatttagatccatgagagattacatgcatttctgtgatttattagtcactaattttgttttaccatatctgtcattgacactatagataatcagaatttatgtatatttaataacttaacttttctgaccaccccaccccaactcca

SEQ ID NO: 77398 - DNA, 601 bp, Human
ttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacaattccttgctgtgaaaagttagccctgggagtagaattctccaaawtgggtcttcggaataatacaatgagtaattgagcattatccagctttggatataactcttgtacttaaaagactttagagcttatcattttatgtatttcatttatttcatttagatccatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaac

SEQ ID NO: 77399 - DNA, 601 bp, Human
gcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacaattccttgctgtgaaaagttagccctgggagtagaattctccaaaatgggtcttyggaataatacaatgagtaattgagcattatccagctttggatataactcttgtacttaaaagactttagagcttatcattttatgtatttcatttatttcatttagatccatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatca

SEQ ID NO: 77400 - DNA, 601 bp, Human
ctttgggaggccgaggagggcggatcacctgaggtcaggtgttcgagaccagcctggccaacatggagaaacccccatcccatctgtactaaaaatacaaaaattagctgggcatggtggcgtatacctgtattcccggctactcaggaggctgaggcaggagaatcacgtgaacccaggaggcagaggttgtagtgagccaaggtcacaccactgcactccatactgggcaacagagcaagactccatctcgagggaaaaaaaaaataagaaagaatttatttatactttataaagattytaaactattactgtgatgactactatgtagtatcacatgtgatagtggtaatgagttttcttctgagattaattgcagagcttgtctttcgtatgggtccaatatattacttttcattgtgttttatttgtgcaagacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttat

SEQ ID NO: 77401 - DNA, 601 bp, Human
ccggctactcaggaggctgaggcaggagaatcacgtgaacccaggaggcagaggttgtagtgagccaaggtcacaccactgcactccatactgggcaacagagcaagactccatctcgagggaaaaaaaaaataagaaagaatttatttatactttataaagattttaaactattactgtgatgactactatgtagtatcacatgtgatagtggtaatgagttttcttctgagattaattgcagagcttgtctttcgtatgggtccaatatattacttttcattgtgttttatttgtgcargacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcgttgtcac

SEQ ID NO: 77402 - DNA, 601 bp, Human
tgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcgttgtcacatatggaagtaagtgaccccgctgtcactgttccatgttttcttgtgaagagctaagttgtcactacccaactgtgacactgcatggaccaactcctgcaggcragtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacacattctacggtgtatttaata

SEQ ID NO: 77403 - DNA, 601 bp, Human
gatttataaaactcaaaaaagagtttaatatctaacacaggaaatcttttcttagtcctttaccattgaattctaagtggtgaaataaaactttggctctttaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctgattcaycacccgtcaggcatggcgaaggtccagtgtctgtttctgaaaaacagtctatctttgccacccccttccatcctccaaaaaagaaaaaggagaccagctagtacaaatacaaattgcaaattgagcataatctaccacttgaagaatgagagctatcagatgtatcaaccgaattaaaaaattccatcttttcacctctccagtctcgttctttttataacatcgttatttagaagagcttaacttcatggtttttaagcctttattaagtaaaaatttagtttgagttttcatttttat

SEQ ID NO: 77404 - DNA, 601 bp, Human
ttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctmtgtttggaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaa

SEQ ID NO: 77405 - DNA, 601 bp, Human
tgcttgccatagtgcccaaaatagctgattattatggaaagataactcagaatatctctactcggatttatcagaaccattcaaaagtggtagttgcctctgagaggagatcaggtatgagttacttatgtttaattgttagctgtttgtattgtctgagcttttttgcttttttggaggggaggagcagtgttaaatcttcatattcgtaccacagttgttttagcagattaagtagttgccttgtaaaagaaagttaaatcaacacaggttaatgttagtggttacgtgtgagggggaratacagtgaatagaacagagtaccttacttggtttaggaactgaggttttagttgccctattgtttcgttgtttgttataaggagtgaaggtatacctacccttcgagtttctgcaaaaatggtggtacccacccctcaagtatctacaaagatggtagggaaatgcataatgcagattttacagttcggttaaggccagtcctgagagaattctttcttcctcctcttctctactttttttacaatgccttttttttttttggcggggggtggtggtggggggtgttgttttctttcaa

SEQ ID NO: 77406 - DNA, 601 bp, Human
gtttcccttactcctcaggtggtaagattctgtgatagccatatggattcctcatttaaatatagaaatctactgaatatggctacaattcattttttatttagttcaaatctgtgcaaggaataactagttacccctaatataatgggtctaaatatgagaaaatgtgaacctccattttgtgatttgtctttctctctctcttttttttggcgattcatttttccttcagctgatgggacggttgacagtggtcagggatcctctgtcttcacagaatctcgagtgagcagccaacagrcagtttcatatggttcccaacatgaacaggcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtggacattagctga

SEQ ID NO: 77407 - DNA, 601 bp, Human
cagccaacagacagtttcatatggttcccaacatgaacaggcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtggrcattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgact

SEQ ID NO: 77408 - DNA, 601 bp, Human
ttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaactyatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctctt

SEQ ID NO: 77409 - DNA, 601 bp, Human
tctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgwtttttttctggattattataactagattttgctaagactttttttttaaaattttctcttgtctatactcatcatgggggagcattaggtctctattttagaaagcaagtagaatgacatgaagatattatttgagccattaatctagctatatttattgatgctctaaaagcagacgttcttgctttttaatgacagtattctatggaggtattatgaagaattattaaatattgagaatttaaaaatttgtctaattctattcttgtctcatttcaggaatgtggcttacaataatat

SEQ ID NO: 77410 - DNA, 601 bp, Human
attataagtgaaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttctttgacagcgtctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattattta

SEQ ID NO: 77411 - DNA, 601 bp, Human
aaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttttttgacagcstctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcaga

SEQ ID NO: 77412 - DNA, 601 bp, Human
aactgatcattatcatgatcattcattaaacctgtccttgactgacaacgcagaatagttgtgaatagttgtgatctgtcagatgtgctatgttgagttatagctctcctcaaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttscctctgtgtcccgcatctctcccagtgctcttccaccccaccgccagtactgtctgcacctctttctccttccctcccccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggac

SEQ ID NO: 77413 - DNA, 601 bp, Human
tcagatgtgctatgttgagttatagctctcctcaaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctccyccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaaggggga

SEQ ID NO: 77414 - DNA, 601 bp, Human
ccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgctgcttttccaaataaagaatatagttaactttctgaackagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggct

SEQ ID NO: 77415 - DNA, 601 bp, Human
cagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactrtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaag

SEQ ID NO: 77416 - DNA, 601 bp, Human
cttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcartcctcctgcctcagctttccacgtagctgggactacaggtgcctgccaccacactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctc

SEQ ID NO: 77417 - DNA, 601 bp, Human
agaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcagtcctcctgcctcagctttccacgtagctgggactacaggtgcctgccaccamactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatgtgtc

SEQ ID NO: 77418 - DNA, 601 bp, Human
actggtaattctaaaattaaatatttatagtgcatcactgatattagttaatagtaattatttgcaagggaataatgcatttttggcataattgaatacttattagctattctacataaaatttgtagccactatgtatgtaatgcaaacttcctaatgttagttccccatgtgggttttttaatcagcaaactctaaactggcttctgtttctattagtttttggttttgaaacaaagttttcggttcttaattacaaatggccctttttcagtccaacatatggtcatgtagtcattcsatactggtttaagatcaggagttgcttgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcc

SEQ ID NO: 77419 - DNA, 601 bp, Human
tgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcctaacttgcttatctttggatgtagacraacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagata

SEQ ID NO: 77420 - DNA, 601 bp, Human
tccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatayatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatccca

SEQ ID NO: 77421 - DNA, 601 bp, Human
agttcaaggctacagtgaactatgatattgccaccatactccagcctgggcaacagagcatgactcatctcaaaaaaaaaaaagcaccgaagttgtgaactacctaccctactatccataaagtctgtttgaactggtttcatgaggcaagcttgggcagagcatgatgctaaactgttaagctagaccacccctgcctggctgaagtgctgattattagtcagtgggactgcgcacagcagatcatcatgtacttctggcatatccagaggtgacacttctccccagatgctctaagatrtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttcagatactgaaggtctaccgagctggaccaggtatgactactttgaaagagtctaaataatatagtaaatatatatgtaaatttctaaaaaacaaataaggataatagctaatattaaagtgctttgtaca

SEQ ID NO: 77422 - DNA, 601 bp, Human
taaactgttaagctagaccacccctgcctggctgaagtgctgattattagtcagtgggactgcgcacagcagatcatcatgtacttctggcatatccagaggtgacacttctccccagatgctctaagatgtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttsagatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattcc

SEQ ID NO: 77423 - DNA, 601 bp, Human
agatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccrcagctcaccatttgactactacccaattatgtccaaaaaaagggaagaaattaacatctctcccaagcaggaaagggaatatcaggaagactttaggaaaaaggaggcatttgaaatggactttgattataagttagactcagatgtagaaataaagaatattccaggccagaagataaaaaaattatactgtgagcaatgtgaaaggccctaagatagaaaaatagggtacaaaaacaaatgtgcctttagtttggtttaactagagcatagatatgtgaaggtataagttcaggaaag

SEQ ID NO: 77424 - DNA, 601 bp, Human
accatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataaggkttacatgaataaaaacctataagagaaaggaaaaaaaaatctagttttattttaatgttatgtaaataggtgcttttcactgcacattttacctgaagatacaacttagatggaatgtgttatgttatgccagaaaactgcaggagcgttcataatttagcttcagtgaaggtaaagatgctggtgtctttacctatgtagagtttgggggagagggagcagtatttctgaattaatatatttaatatgcaatcttatttacgtgtgtaaattaatgagttagataattatagatatctc

SEQ ID NO: 77425 - DNA, 601 bp, Human
tttgtagattatcacctaacaaaatctaagacacttatcaaggtggcaagatacataataaatgtacaaataaatagcttatctttataccagcagtaaccaattagtcgtatgggtataccagcacatacgtaaaaggctgttggttgcagcattattttaagtagcaaaaatgaaacaaccaaagtgtttatcattaggagactgatgccatttagaaattaaagtagtatgctatagaacactatgtataggaaaggcatgtttttgttttgtttattttaacaaaaaaagaaaactrtgtgaaaatggccacttacgcatagaaaaaaatccatgaaggttatgcaccaaacgactaatagtggttacctctggagaataggattaggggtattttcattaactttataatatgatgtactagttaaaatttttattacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctca

SEQ ID NO: 77426 - DNA, 601 bp, Human
gtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttyttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgag

SEQ ID NO: 77427 - DNA, 601 bp, Human
gtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttrgacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatatttttatgtggcat

SEQ ID NO: 77428 - DNA, 601 bp, Human
agggttttgttggtttggtgtttttttttttgtttgttttttccttctttttggctaatacataaatcttgcttttggcagccttgctttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtac

SEQ ID NO: 77429 - DNA, 601 bp, Human
tagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagt

SEQ ID NO: 77430 - DNA, 601 bp, Human
ctagatgctgaatattgagaatttactagtaaatttagtgcttctaggacgtagtggggagggataaggaaaaaaataagtagattattggggatagtgaatgataaatctattactaccgagatttgagttatcttttcgattcacagagtactcagggagtctctcaggttgctcctgcagagccagttgcagtagcacagacccaagctacccagccgaccactttggcttcctctgtagacaggtacgtaaaactagaattctccttccttgactggtaaataagacggtatgaaaygccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtca

SEQ ID NO: 77431 - DNA, 601 bp, Human
gtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtakgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtc

SEQ ID NO: 77432 - DNA, 601 bp, Human
ctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaayacagcacctccaaactttagtcatacaggaccaacatttccagtagtacctcctttcttaagtagcattgctggagtcccaactacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgca

SEQ ID NO: 77433 - DNA, 601 bp, Human
aaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtat

SEQ ID NO: 77434 - DNA, 601 bp, Human
ctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaat

SEQ ID NO: 77435 - DNA, 601 bp, Human
aatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatrgtctttgtttcagtgagaatgaagcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgc

SEQ ID NO: 77436 - DNA, 601 bp, Human
tattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatggtctttgtttcagtgagaatgaagcaaatttttggttttgttgtagattccacagttgtacagtttggggsttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcaga

SEQ ID NO: 77437 - DNA, 601 bp, Human
aacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagargaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggca

SEQ ID NO: 77438 - DNA, 601 bp, Human
ctgtaacctaaaccattattaatacctttaacatgtattcagagttcctgcttattctagccaaaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcrggcggatcacaaggtcaggagatcgagaccgtcctggctaacacggtgaaaccccatctctagtaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctat

SEQ ID NO: 77439 - DNA, 601 bp, Human
aaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcgggcggatcacaaggtcaggagatcgagaccgtcctggctaacacggtgaaaccccatctctastaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctatgagaaaaattaagaaagcaatcaagaattaagagtagaaattcattcttttaaaatgtacctt

SEQ ID NO: 77440 - DNA, 601 bp, Human
gaaaaaggaaagaagataaaatgttctcagacataagtgtttcatcacatatactgtctttctgcccttttacaaagaccataggaaaggcaacgaggcaaaagtttgagtgactgaagctaaagatttgtggtgtctgtctgtgtgtgttttacagcctgtgtccatggcggctccaacagcaatcacagaagcaggaacacagcctcagaagggtggtgagaaacatccttcctccttttatattactaattccagccctacccgtagttgattcaggaggtttaccgtttcaaagacrcatttccacgtatttgataactgaggagcattggtagtaatatctaaagcttgaaagattagcaaattaataaatctgttccgttattatttgtcagaggaaaggttatacaggaggtaatgataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaa

SEQ ID NO: 77441 - DNA, 601 bp, Human
ataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaagatttcagttaatcaatttaaacatttttattttcaaggcaattatattctcaattggctctcattttaaaagtgatttgcaaatcattagaatggtctagaaatggaaaaatgaaaggggartgtagattatcaaaatatgtagagtatcaagtatgtacaatgaaaataataaagattactaccaataaaaagagaatgtagaatatgaaaaaggtagcttttcaaatcattggaagatggaatatttctttttttttgaagtggagtttgctcttgttgcccaggctggagtgcagtggcatcatctcgactcattgcaacctccacctcccaggttcaagcgattttcctgcctcagcctcccaagtatctgggattacaggcatgcaccaccacacctggataattttgtatttttag

SEQ ID NO: 77442 - DNA, 601 bp, Human
gcctcggcctcccagagtgctgggattacaggcgtgagccaccgcgcctggctgaaagatggaatatttttataagtggtttagaacaacttgaaagccatctggaaaaaagcaaaggtggatcactagcctagacataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggartgtgggctgaggacccttttggggtgcctatgagggcaacactattttacagtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccac

SEQ ID NO: 77443 - DNA, 601 bp, Human
agtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccacagttatgaatatcttattactattatttcagatcccacattataactaactttttttttttttgtggcttggaaatcttttttttttttaattttattattattatacttttaagttttagggtacatgtgcacaacgtgcaggtttgttacatatgtatacatgtgccatgttggtgtgctgcacccattaactcgtcatttagcattaggtatatctcctaatgccatccctcccccgtcccaaggggatttttttcaactatctagagcagggttcacaaactctttttctgtaaagggcgagatggtacaaattttaggctttctagaccatatagtctcttgcaac

SEQ ID NO: 77444 - DNA, 601 bp, Human
cgattgcaaatataaatgaaaaactggggaaatatatatatttgtgggagggggaggggtatgtgtagtcatatcacaaaaagaactcgttttgctaatacaaagagttcctaaaattcaacatgaaccaaaaaacaatcaaaagataacagaaaaggaaacttagacatgaaaatatttaatgtccgtaatgatagaaacacaaagtaaggctacaagtgatagcaattcccacctctcattggtaaattcaggggtctaatagccaccagtgacttggtacagcctctggggggatcartttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcagga

SEQ ID NO: 77445 - DNA, 601 bp, Human
tgaaatatatatatggtatatacatagggtatgacactatgcaatcattaaaaagaatgaggcattgatatggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcragaccatcctgactaagacggtgaaaccccgtctctactaaaaatacaaaaaattagtcgggtgtggtggtgggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggtttt

SEQ ID NO: 77446 - DNA, 601 bp, Human
ggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcgagaccatcctgactaagacggtgaaaccccgtctctactaaaaatacaaaaaattagtcgggtgtggtggygggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcatttaacaatggatcttggctggacatggtgattcacacctgtaatcccagcactttgggaggctgaggc

SEQ ID NO: 77447 - DNA, 601 bp, Human
tggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcatttaacaatggatcttggctggacatggtgattcacacctgtaatcccagcactttgggaggctgaggcaggcatattacctgaggtcaggagttcaagaccagcctggacaaygtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcacttacttatatatctgaattaaagaatgagtaattgagtttttaaagcctgttaacctttg

SEQ ID NO: 77448 - DNA, 601 bp, Human
tttgggaggctgaggcaggcatattacctgaggtcaggagttcaagaccagcctggacaacgtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcayttacttatatatctgaattaaagaatgagtaattgagtttttaaagcctgttaacctttgtttttatagtatatgttaatgttgtagttggtatctagtagtagagcaaacaataactcttttcccctgttggacagagcctcatggagggaggagataaggaagttctctttgcctctaacagctttcctcatgtgtagtttgattttgctgtatttctagctaaagggaaaagaagttaactggaaggagacacttatgttttcctcatccatgtatttgtttcagtttctcaagtca

SEQ ID NO: 77449 - DNA, 601 bp, Human
catatcactttattttaccaggttgtccaacatgtgagcattttctggctggggagagtaggtgatatttttctcatttgtaaacaggtcctgaacctttataggtgggctgagtttgtatttgtaaatacatggacaaaccagaacaaggatctggatcctcttttttagttaccagttagttgtgttgattcttgaggcataccaggcatttaacatttaccttgtagtttttcttattcacaggcaaccctaaaaattctacaatgccttgctaatttattttatttatttacttttrttttatttttttatttttatctatttatttatttttgagacggagtctcactctgtcacccaggctggaatgcagtggcatgatctcagcccactgcagcctctgcctcccgggtttaagtgattctcctgcctcagcctcccaagtagctgggattacaggcacacgctaccatgcctggctaatttttgtatttttagtagagacagggtttcaccacgttggccaggctgatctgaaactcctgacctcaagtgatccacctgcttcagcctcccaaaatggtgggcttacaggcat

SEQ ID NO: 77450 - DNA, 601 bp, Human
tgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattcttttttyccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagaca

SEQ ID NO: 77451 - DNA, 601 bp, Human
caaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaat

SEQ ID NO: 77452 - DNA, 601 bp, Human
gagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcag

SEQ ID NO: 77453 - DNA, 601 bp, Human
gtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacaygattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgt

SEQ ID NO: 77454 - DNA, 601 bp, Human
caggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctacmttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccac

SEQ ID NO: 77455 - DNA, 601 bp, Human
tgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagcaccgtgcccggccctggactatattttaattgggatagatagagagtttctaatcctttggtgaaattatggtagtgttaacacaattagttgaaaagtaaaagaaggttaaaataygttaaaaagcagttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgttttgtttttgtttttgtttttgtttttttgaggcagagtcggcagtggctcaacctccaactcccaggttcaagcaattctcatgccccagcctcccaagtagctgggattacaagcatgtaatcccaaaccaaat

SEQ ID NO: 77456 - DNA, 601 bp, Human
ttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgttttgtttttgtttttgtttttgtttttttgaggcagagtcggcagtggctcaacctccaactcccaggttcaagcaattctcatgccccagcctcccaagtagctgggattacaagcatgtaatcccaaaccaaatgtataagaacacytggctaatttttgtatttttgtatttttagttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatc

SEQ ID NO: 77457 - DNA, 601 bp, Human
gcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttcttttttttttttttttttttgagtgcagtggcatgatgtcggctcactgcagcctctgcctctgggttcaagcaattctccttcctcagcctcctgagtagctgggattataggcaccctccaccacgcctggctaattttta

SEQ ID NO: 77458 - DNA, 601 bp, Human
cattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttctttttcttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcgaactcctgacctcaggtgatccgcccaccttggcctcccaaagtgctgggatattataggcgtgagccacaacacccagcctatctattgagtcttagtgtcattcctcacttct

SEQ ID NO: 77459 - DNA, 601 bp, Human
taggtactctggtcttcttacgctgctcagacatgtggcccatctaggttttctaaagctaaaaagctctggaatagtacatatggccctattacctatggattcttttcttttttttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcraactcctgacctcaggtgatccgcccaccttggcctcccaaagtgctgggatattataggcgtgagccacaacacccagcctatctattgagtcttagtgtcattcctcacttctcccgttagtgaggactttgttcttctcatcagtttgtagcttttgacccatcattcatcactcagtggaacaaaccaaatgtataagaacagtgcctgatgagtgcatgggaagagctggacatgtttcctcatgccactttatcttttggcaggtaacctgtctggtcagagtgcagcttcagt

SEQ ID NO: 77460 - DNA, 601 bp, Human
tggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaayataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttcta

SEQ ID NO: 77461 - DNA, 601 bp, Human
ggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagtgactagatttaaagcgaagcatatgacacgtttaactgccatttccctcacacatacccctgttatttttacctgcrttagaaatggattggctccttccagcacccctattatttgtacctgtattagtaatgagttagctgtacttgagaggcagtctttactgactttccccacatgcactagtcccaggctgtttaacaaagaagcgggtggaaggcattacccaattcgatcgttttccaggcttgtgtgattttttttttgaggactcagatcaataatttttctggtcagactttcctggactgtgcatattagcactttgacagttgaataagcatttaatttgcatgtccacctagaaagttgcaagg

SEQ ID NO: 77462 - DNA, 601 bp, Human
aggatacatcatgtaagcctggtgaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactrtcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatct

SEQ ID NO: 77463 - DNA, 601 bp, Human
ctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggarttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctc

SEQ ID NO: 77464 - DNA, 601 bp, Human
tgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccagrtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaat

SEQ ID NO: 77465 - DNA, 601 bp, Human
agcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccraaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgg

SEQ ID NO: 77466 - DNA, 601 bp, Human
actttaaccgtgcccaatgcacaagaaaacctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttcccttcttgcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaa

SEQ ID NO: 77467 - DNA, 601 bp, Human
cctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttcccttcttgcatggcttcccagttcatcctctyctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgaggtaagtctct

SEQ ID NO: 77468 - DNA, 601 bp, Human
atataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtargtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttga

SEQ ID NO: 77469 - DNA, 601 bp, Human
ggttttatattatttacttgtttcaaatttctctctatgaaaattatttttctaagcaaattataatctctttaggctaggagtttgtctctgtctttcctcctctgtgtccagcattgacctagtcctgtggtcaggaaatagcaggccctgaatgaatattagagaatgattgattgattgatattgagcttgtggcttttcctatttttaaattgtatattgttaaagtaaaataaattatactttttcttttttaacaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaaggtagaatgggttttatattttcaaactaaaataagttaatggaaaatttttatgtatagaaaggccactaattgtcaaaaagaacattatatctcatattacaatttttccattgaagcgtacattaaaatattaacaaaataatccctatattgatttaaatcagtttttaatctgattgaagttatt

SEQ ID NO: 77470 - DNA, 601 bp, Human
gtagttttatgggttgaggtctttagatttaagtctttagttcattttgatttgtttttgtatatggctagaaataggggtctagtttcatcctagcaccatttattgaagtgactgtcttttccccattgaatgttcctggcacctttgtcaagaataagctcactgtaggtgtgtggatttgtttctgggttctctattctgattcattggtctatgtgtctgtttatatgccagtaccatgctgttttggttactataactctatagtataatttttttttgagatggagtctcgctytgtcacccaggctggagtgcagtggcatgatctcggctcactgcaagctccacctgctgggttcatgccattatcctgcctcagcctcctgagtagctgggactacaggcacccgccaccacacccagctaatttttttttttatttgtagtagagatgaggtttcaccatgttagccaggatggtctcgatctcctgacctcgtgatccgcctgcctcggcctccgaaagtgctgggattacagcttgagccaccgtgcctggccactctgtagtcactcttctagagtggcagtttgg

SEQ ID NO: 77471 - DNA, 601 bp, Human
atgaccctgtaaaggataagatatggggctagtttttccaaggggcttctattggctctgtaggtcagcctccttttctcaaggcaatcggaaaatgtcattccagtcaaggacttagtaaaataacgagtgtctcgaattacgtcctgtgataaaagaaaatatattcttattaaacttatgcaaataattatattgccataaattgagaatactctcaaaatagttttcaaattttggagaaattaggttgagagaaaggaattatatttttaattttgctcataagaacaaattttastgaatttactaaattcactttattaaattgttaaagctgtaaatagcttaaaaggaaagttttcttgactctgaaaaataaaaccaatcagcaaatgttttaaacaaaatcttatacaagattatttcagtcttctattagtttggtccatgcaattaactccatgttctgctcaatattggatcagcaagacttattaatacatgagctctccatgaaaggcctggacattttcctatctattccaatgatgctatatctaaatttatcaaaaacttattttttaggagtactcctcag

SEQ ID NO: 77472 - DNA, 601 bp, Human
tgtgtgactttactataccaaataagtcaaatatgtctcttttggacttccggtgacctattattaataaatatatgaagtcaaagtactaattttacaatttaattttggaaagtctgtcaaatgtcagaagtttaaaatacttaatatgataatataggctcataggtcattgtaaaagaaatcattcatttagtcaaagtgataactcaaagtttttttaaaaaaggcaaaaatctttattttttgagagaggagacttaatttcccaaacaatgagccctaagagagactgcatgargccaattaaatctgtctctcaaatcttataaacaaatctattaaattttaatcattttgaccataagctataatttccataaacctttaaataaccttttaatgtttttttaaattaaaaagtgggttaatgctataagaaccttgtttatctaacgcaggggtcctgatgctggtctttcatcaaactataatattaatgtgtaatttatatggaaactctgaactaagtttatctctcaaaattggcccttataatttcacagacgcatgtcttctgtgacagtccctgggattagag

SEQ ID NO: 77473 - DNA, 601 bp, Human
ataggtcattgtaaaagaaatcattcatttagtcaaagtgataactcaaagtttttttaaaaaaggcaaaaatctttattttttgagagaggagacttaatttcccaaacaatgagccctaagagagactgcatgaggccaattaaatctgtctctcaaatcttataaacaaatctattaaattttaatcattttgaccataagctataatttccataaacctttaaataaccttttaatgtttttttaaattaaaaagtgggttaatgctataagaaccttgtttatctaacgcaggggycctgatgctggtctttcatcaaactataatattaatgtgtaatttatatggaaactctgaactaagtttatctctcaaaattggcccttataatttcacagacgcatgtcttctgtgacagtccctgggattagaggggttcagcagttttaatttctggcactgtgtctcatgaatgcagtttattttgattatcatcttttcctgggtctgaagatgagggtttgactggtgttacggtttaagatttagcaggacttggtgtgctttttagacccagaagtaaaagccctttaattt

SEQ ID NO: 77474 - DNA, 601 bp, Human
cttgtttatctaacgcaggggtcctgatgctggtctttcatcaaactataatattaatgtgtaatttatatggaaactctgaactaagtttatctctcaaaattggcccttataatttcacagacgcatgtcttctgtgacagtccctgggattagaggggttcagcagttttaatttctggcactgtgtctcatgaatgcagtttattttgattatcatcttttcctgggtctgaagatgagggtttgactggtgttacggtttaagatttagcaggacttggtgtgctttttagacccmgaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatgtggtggtgtgcgcctgtaatcccagctgctcagaaagctaagacaggagaattgcttggatttgggaggcagagattgcagtgagtcgagattgtggcactgcactccagcctgggtgacaga

SEQ ID NO: 77475 - DNA, 601 bp, Human
tttaatttctggcactgtgtctcatgaatgcagtttattttgattatcatcttttcctgggtctgaagatgagggtttgactggtgttacggtttaagatttagcaggacttggtgtgctttttagacccagaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattakccagatgtggtggtgtgcgcctgtaatcccagctgctcagaaagctaagacaggagaattgcttggatttgggaggcagagattgcagtgagtcgagattgtggcactgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataa

SEQ ID NO: 77476 - DNA, 601 bp, Human
tctggcactgtgtctcatgaatgcagtttattttgattatcatcttttcctgggtctgaagatgagggtttgactggtgttacggtttaagatttagcaggacttggtgtgctttttagacccagaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatrtggtggtgtgcgcctgtaatcccagctgctcagaaagctaagacaggagaattgcttggatttgggaggcagagattgcagtgagtcgagattgtggcactgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataagaataac

SEQ ID NO: 77477 - DNA, 601 bp, Human
gacttggtgtgctttttagacccagaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatgtggtggtgtgcgcctgtaatcccagctgctcagaaagctaagacaggagaattgcttggatttgggaggcagagattgcagtgagtcgagattgtggcamtgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataagaataacgaattattttgataaatgtaaaatctgttagacaagttaacaaaaagaataaaaaagatcttctatattatgtttgctttttcctatgaggagtacattt

SEQ ID NO: 77478 - DNA, 601 bp, Human
taatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatgtggtggtgtgcgcctgtaatcccagctgctcagaaagctaagacaggagaattgcttggatttgggaggcagagattgcagtgagtcgagattgtggcactgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataagaataacgaattattttgataaatgtaaaatctgttagacaagttaacaaaaagaataaaaaagatcttctatattatgtttgctttttcctatgaggagtacatttaaataacatgcaatcaaaactaatgtaaaccgtacttga

SEQ ID NO: 77479 - DNA, 601 bp, Human
ctaagcaaataaaaacttaataagaataacgaattattttgataaatgtaaaatctgttagacaagttaacaaaaagaataaaaaagatcttctatattatgtttgctttttcctatgaggagtacatttaaataacatgcaatcaaaactaatgtaaaccgtacttgaattagttagatatagaaagagtgtgttccgggtgataaatgaaaattcttggtttcatagaacaattaaagccaagagcacagagggttatgttagaagaaaacattttatttagacctttaaggtaaaactttttttttataatgtcaggccacaatagcagaacctgagggaaaaaaattacagaagctattgacaaagttgaaggagaaagttattatctcaatccttctcaaagggaagagaaagctgaaagcagtgggacacaataaaagttgaacttttgggttaaaaaattaaaatctcttgtaattttattaagagtgaatcaataccttaagaaaatgttgttctaaccaattctttagtgaattaattcttttttaatatcaagtctcaatctctggaatgactattataaataatttccct

SEQ ID NO: 77480 - DNA, 601 bp, Human
atgaaaattcttggtttcatagaacaattaaagccaagagcacagagggttatgttagaagaaaacattttatttagacctttaaggtaaaactttttttttataatgtcaggccacaatagcagaacctgagggaaaaaaattacagaagctattgacaaagttgaaggagaaagttattatctcaatccttctcaaagggaagagaaagctgaaagcagtgggacacaataaaagttgaacttttgggttaaaaaattaaaatctcttgtaattttattaagagtgaatcaataccttaagaaaatgttgttctaaccaattctttagtgaattaattcttttttaatatcaagtctcaatctctggaatgactattataaataatttccctttaattatagcaaacttgatcacttttttttttactcataaatcctcttcttacaaaccttattacaatttatacaaatcatgtatgatatgcttggactttctgtgttatcctaaaggtacctctttcttaaataaccagtcattttagaaaaaaaaaattaatcacacaagattctttctcatataaaattattttcccttcagc

SEQ ID NO: 77481 - DNA, 601 bp, Human
aatagcagaacctgagggaaaaaaattacagaagctattgacaaagttgaaggagaaagttattatctcaatccttctcaaagggaagagaaagctgaaagcagtgggacacaataaaagttgaacttttgggttaaaaaattaaaatctcttgtaattttattaagagtgaatcaataccttaagaaaatgttgttctaaccaattctttagtgaattaattcttttttaatatcaagtctcaatctctggaatgactattataaataatttccctttaattatagcaaacttgatcacttttttttttactcataaatcctcttcttacaaaccttattacaatttatacaaatcatgtatgatatgcttggactttctgtgttatcctaaaggtacctctttcttaaataaccagtcattttagaaaaaaaaaattaatcacacaagattctttctcatataaaattattttcccttcagcttttcttaccaaaaatacctctttatacctacaactttctgtgtatctctcttatatactagtttctttcactttgtttcataaactttagcctttgtattagacaaaaattatttt

SEQ ID NO: 77482 - DNA, 601 bp, Human
acacttatttattaaggattttcttaagtcacatgaacttgaaaaagcatttgggcttttctgtcttctgtttttctgataaagtatttgatttaaatgcttttgtaaatccaattaattacagctcctttatatatttttagtagtgaaacgtacatgacacataaatacgtagacttattagtcatgaagataaaagtagatcttaaagattcatattttagatattttagacttccaatttagatatttcagacttccaatttctttttttttctttttgagacagagtctcactccrttgcccgggctggagtgcagtggcatgatctcagttcactgcaatctgtatctcctgggttcaagcgattcttctgcctcagcctcccgagtagctgggactgcaggcacatgccaccatgccaatctaatttttgtatttttgtagagacagggtttaccatattggccaggctgctctcgaactcctgacctcatgatccgcccgccttggccttccaaagtgctgagattacaggtgtgagccacggtgcacaagctccaatttcttatgacctgtttaactagatagccctaaatt

SEQ ID NO: 77483 - DNA, 601 bp, Human
caggcattaagaactgagaaacttgtctgattgcactcttggggttccataaggaaaaacagagatttctccccaaaaaggagtctgggaggaaacctgtattttcttaaggaatcccaggctgttagaaatgattttaggtccctcacacagtggagggtggcaagaagaaggaaagacatgtagaagtaaatgaatgaaacagtcaactgagctgtttcttctcagccaactgagaagaaaaaagaactttttctcaaaaaacaagatcctaggagagaaagaaagcataaaggcacayacacacatacacacacacacacacacactcacacacacatcttggatattagcttttaattaagctgatttttaaccatggaactaaatacatccttttaaatttcattaccatattttagctgtgacaaactgctgatatttcaaaagtaacacaactatcaacccagaaaagattggatttaggaaccaaacccaggctgtcatggtgaaaaaagggcagaatcttagctactgaactacagcatggggtaactaccattgctctgtcctcttggcttggctaggaataaatggccct

SEQ ID NO: 77484 - DNA, 601 bp, Human
aacagacaattgtacaatttataggatcgctgagtgatctaatcgtacggagaaattaaggccagctagttgctaatcttaacttttagtaattaaggagaatttccaagacaaaaactacaattcagctactgcctaggaatggggcccaggctgaacactgctctctaccatcctagaagcagggaaaactcaaactcaccttccctgcgggaagtgggctgaaacttcagaaaggagttgttggtctccttcatcatcatggagcaggaaaactccccttctttgtttgaagcaagtraaactccagaaaaggtgttgcacaacaaaataaatcttagatcttaaccaaattttgagagatcaggcattctctctgcagtgggagccccctgaccttggcaaaatgtgcaattggttttgttacaggaaaggggtcccaatccagaccacaagagagggttcttggatcttgctcaagaaggaattcagggcaagtccacagtgaaaagttaaagcaagtttattaagaaagtaaaggaataaaagaatagctattccatagagagagcagccccgagggctgctggttacccatttt

SEQ ID NO: 77485 - DNA, 601 bp, Human
gtaaaggaataaaagaatagctattccatagagagagcagccccgagggctgctggttacccatttttatggttatttcttgatgatatgctaaacaaggggtggattattcatgcctcccctttgtagaccgtatagggtaacttgctgatgtggccatggcatttataaactgtcatggcgctggtgggagtgtagcagtgaggatgaccagaagtcactctgtggccatttggttttggtgggttttggccagctcctttactgcaacctgttttatcagcaaggtctttgtgacctrtattttgtgctgaacttctgtctcatcctgtgacttagaatgccttaattgtcggggactgcagcccagtaggtttcagcctcattttatccagcctctattcaagatggagttgctctggttcacatgcctctgacagtgtgagcaatgaagatagctcaagcttgcacctggcgcccgtaagagccttgtgaaaggttagggccatctccactaagagtccttcccttggtcaccaatttacaaatttgtaaatcaaaaggtatgagagataggtcttaatcaatttagaagtttatt

SEQ ID NO: 77486 - DNA, 601 bp, Human
caaggggtggattattcatgcctcccctttgtagaccgtatagggtaacttgctgatgtggccatggcatttataaactgtcatggcgctggtgggagtgtagcagtgaggatgaccagaagtcactctgtggccatttggttttggtgggttttggccagctcctttactgcaacctgttttatcagcaaggtctttgtgacctatattttgtgctgaacttctgtctcatcctgtgacttagaatgccttaattgtcggggactgcagcccagtaggtttcagcctcattttatccagmctctattcaagatggagttgctctggttcacatgcctctgacagtgtgagcaatgaagatagctcaagcttgcacctggcgcccgtaagagccttgtgaaaggttagggccatctccactaagagtccttcccttggtcaccaatttacaaatttgtaaatcaaaaggtatgagagataggtcttaatcaatttagaagtttattttgcaaaggttaaggatgcacgggggagacaggcctgtgcctttctcaaaagattattttgagggcttcaatatttaaaggggaaaaataggttg

SEQ ID NO: 77487 - DNA, 601 bp, Human
gttcacatgcctctgacagtgtgagcaatgaagatagctcaagcttgcacctggcgcccgtaagagccttgtgaaaggttagggccatctccactaagagtccttcccttggtcaccaatttacaaatttgtaaatcaaaaggtatgagagataggtcttaatcaatttagaagtttattttgcaaaggttaaggatgcacgggggagacaggcctgtgcctttctcaaaagattattttgagggcttcaatatttaaaggggaaaaataggttgaaggggaaggagaggtgagggtatgktcacaattctgaatccacaggttgccagagaaaaatgagcaggtaggtaaatagtcaagtatgtatgcatcttgcacttagtaaactgacactttaaacaagataaagtgaacatagagtacctactcctggagatatttaacctttatacctgtagctacctgcttaggaacaaaagaaaaagccgcttttggtgactcagcttcattttgtttcttttggcatagtaaattggggtcccaagtatttatttcctttcacagaattcacttgcaataatgttaaacaaggttcctttta

SEQ ID NO: 77488 - DNA, 601 bp, Human
aactctttaaccagcttgattttcatagtatttatcaccagctgacactaagaccccaaaacgcacctgtgtagaagtgcgtgtttgcgcacgtgtgtttaatggcataaaacaaacaaaaaaaattatcttagagatctaaaatccagaaatcagaaataagtgtcagtgaactaaactcagggggttggcaagaccatgtttctttctgaaaattctagggacaatacacttctttgttttctccagtttctagaggctgtctgaattccttggctcatggcccttttccgtgttcaargctagtgaagtccacgtcacatggatgcttctttcacatttaaaggagccttgtgattacaatggattcactaggccaggtcaagtcaatctctttgttttaagtcatctgtttagcaaccttaattccatgtgcaattttaatatctccttgccatgttacctaacatatttacaagttctggagattaggacctggatgtctttaagggtcattactctacctaaggttatattatatataacattacatctatatattctccatatatatgaagaatacatatatatagtttatata

SEQ ID NO: 77489 - DNA, 601 bp, Human
tctctttgttttaagtcatctgtttagcaaccttaattccatgtgcaattttaatatctccttgccatgttacctaacatatttacaagttctggagattaggacctggatgtctttaagggtcattactctacctaaggttatattatatataacattacatctatatattctccatatatatgaagaatacatatatatagtttatatatgtttactatatatacacacatatatagtttgatatataaatatatacacacatatacacagatatatacatatgtttactatgtatgtrtatacatatatagtttatatatgtatattgtacacatatgtttactatatatacatgaatatatacatatattgcatatatacactatatatagtatataaaatagagtatgtaaactattatatacacacaaactgtgtgtgtgcatatatacatacactttatggtatagagagagatgataaattacatgtatattacatatatttacatatgtaatttatttatgtaatatgtattacatatatgtagtttatcatctatctctctatttcataaagtgtgtgtgtatatatctat

SEQ ID NO: 77490 - DNA, 601 bp, Human
tagtttatcatctatctctctatttcataaagtgtgtgtgtatatatctatatatgcacacacacagtttgtgtttaaataagtttatatactctatatactatatatagtgtatgtatacaatatatatattcatgtatatatagtaaacatgtgtacacatacatatgtacacatatacatatataagctgtatatgtatatacatacatagtaaacatatatgtctatgtgtggatatgtgtatatgtattatatttatatatgtatttatatattatatgtgtgcatatataaaaatataaatatatataaatatatacacatatataatatataaatgcatacatagatataatacatacatacacatataaaatatatgtatttatatatcaaactatatatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgt

SEQ ID NO: 77491 - DNA, 601 bp, Human
tgtctatgtgtggatatgtgtatatgtattatatttatatatgtatttatatattatatgtgtgcatatataaaaatataaatatatataaatatatacacatatataatatataaatgcatacatagatataatacatacatacacatataaaatatatgtatttatatatcaaactatatatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctcca

SEQ ID NO: 77492 - DNA, 601 bp, Human
atataaatatatataaatatatacacatatataatatataaatgcatacatagatataatacatacatacacatataaaatatatgtatttatatatcaaactatatatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacrtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctccatgaaaacataggtgtttgattcactgttctctctggcaaacatcagtgctcagtgtgtataagctgaatgactga

SEQ ID NO: 77493 - DNA, 601 bp, Human
atatataaatatatacacatatataatatataaatgcatacatagatataatacatacatacacatataaaatatatgtatttatatatcaaactatatatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctccatgaaaacataggtgtttgattcactgttctctctggcaaacatcagtgctcagtgtgtataagctgaatgactgatgcaagag

SEQ ID NO: 77494 - DNA, 601 bp, Human
tagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctccatgaaaacataggtgtttgattcactgttctctctggcaaacatcagtgctcagtgtgtataagctgaatgactgatgcaagaggtgggtccctcagtcttgggcagctccactcctgtggctttgcagggaacaaccctcctcccagctgctttcatcagctggcattgggtatctgtggcttttccatgtgc

SEQ ID NO: 77495 - DNA, 601 bp, Human
tcacttcttgacttctgtgcacctgtaagctcaacaccatgtggaagctgccaaggcatggggcttttaccttctgaagccacagtccaagctgtaccttggccccttttagccatggctggagtggctggaatgcagggcaccaagtcatgagactgcacacagcaggggggccctggaccaggctcaggaaaccatttttcccttctagacctccagacccgtgatgggcgtggctgctcccaaggtctctgatgtgccctggagtcattttccgcattgtcttggcaattaacatttktctcctcattacttactcaaatttctgctgcctgcttgaatatccccccagaaaatgggtttttctttcctactgcattgccaggctgcaaatctttcacacttttatgttctgcttcctcttgtacactttgctgcttagaaatatcttccaccagataccctaaatcatctctctcaagttcaaagttccacagatctctagggcagaggcaaaattctgccagtctctttgctacagaataacaagaatcacatttgctctagttcccaaaaagtttctcatctttatctgatacca

SEQ ID NO: 77496 - DNA, 601 bp, Human
agccatggctggagtggctggaatgcagggcaccaagtcatgagactgcacacagcaggggggccctggaccaggctcaggaaaccatttttcccttctagacctccagacccgtgatgggcgtggctgctcccaaggtctctgatgtgccctggagtcattttccgcattgtcttggcaattaacatttgtctcctcattacttactcaaatttctgctgcctgcttgaatatccccccagaaaatgggtttttctttcctactgcattgccaggctgcaaatctttcacacttttatgytctgcttcctcttgtacactttgctgcttagaaatatcttccaccagataccctaaatcatctctctcaagttcaaagttccacagatctctagggcagaggcaaaattctgccagtctctttgctacagaataacaagaatcacatttgctctagttcccaaaaagtttctcatctttatctgataccacttcagcctggactttattgtccatatcagtatcagtgttttgataaaagccattcaacaagtctcttggaagtaccaaactttcccacatcttcctgtcttctgagccc

SEQ ID NO: 77497 - DNA, 601 bp, Human
ggaagttcaaactttcccacattttcttgtcttcttctgagtcctccaaactgttccaacttctgcccattacccagttccaaagctgcttccccattatcaggtatcctgtagcaatgcccctcagtaccaatttactgtattattccattctcctgctgctaggaagaaacactgaagactgggtaatttataaagaaaaagaagtttaatggactcacaatttcaaatggcaagggaggcctcacaatcatggtgaaacgcagaggagcaaaggtacatcttacatggcagcaggcaraagagtgtgtacaggagaactgcactttataaaataatcagatcttgtgagacttattcactatcacaagagcagcataggaaaaacccatccccatgataaagttagctcccactgggtcccttccatgacacatggggattatgggagctacaatttaagatgagatttcagtggggacgcagccaaaacatatcactattataaatatcatcttttcaaattaagtttatgtgatagattacatgaattgattttcatacattgaaccagccatgcatacctggaataaatcccatt

SEQ ID NO: 77498 - DNA, 601 bp, Human
caaactttcccacattttcttgtcttcttctgagtcctccaaactgttccaacttctgcccattacccagttccaaagctgcttccccattatcaggtatcctgtagcaatgcccctcagtaccaatttactgtattattccattctcctgctgctaggaagaaacactgaagactgggtaatttataaagaaaaagaagtttaatggactcacaatttcaaatggcaagggaggcctcacaatcatggtgaaacgcagaggagcaaaggtacatcttacatggcagcaggcagaagagtrtgtacaggagaactgcactttataaaataatcagatcttgtgagacttattcactatcacaagagcagcataggaaaaacccatccccatgataaagttagctcccactgggtcccttccatgacacatggggattatgggagctacaatttaagatgagatttcagtggggacgcagccaaaacatatcactattataaatatcatcttttcaaattaagtttatgtgatagattacatgaattgattttcatacattgaaccagccatgcatacctggaataaatcccatttgatcat

SEQ ID NO: 77499 - DNA, 601 bp, Human
tgggtaatttataaagaaaaagaagtttaatggactcacaatttcaaatggcaagggaggcctcacaatcatggtgaaacgcagaggagcaaaggtacatcttacatggcagcaggcagaagagtgtgtacaggagaactgcactttataaaataatcagatcttgtgagacttattcactatcacaagagcagcataggaaaaacccatccccatgataaagttagctcccactgggtcccttccatgacacatggggattatgggagctacaatttaagatgagatttcagtggggacrcagccaaaacatatcactattataaatatcatcttttcaaattaagtttatgtgatagattacatgaattgattttcatacattgaaccagccatgcatacctggaataaatcccatttgatcatggtatttaattattttatgtttcgtgtattattgaatttttttactaatatttgttgaggatttttacatctatgttcatgagtgatattggtctacatttttttgttattgtaatatcttggattttagtatcagggtaatgctggcctcatggaataagatagaaagtattcc

SEQ ID NO: 77500 - DNA, 601 bp, Human
atcccatttgatcatggtatttaattattttatgtttcgtgtattattgaatttttttactaatatttgttgaggatttttacatctatgttcatgagtgatattggtctacatttttttgttattgtaatatcttggattttagtatcagggtaatgctggcctcatggaataagatagaaagtattcctgatgcttttatcctgtgaagaaggttgtatacaattagtataacatgtttcttaaatgtttggtataattcaccagtgaaactatctgggcctcattctttctgtttttwgttttgttttgtttttttgagatggagtctcgctctgttatccaggctggagtgcagtggtgctgtctcagctcactgcaacctctgcctccctggttcatgccattctcctgcctcagcctcctgagtagctgggactacaggcacccaccaccacgcctggctaattttttgtatttttactagagatggggtttcactgtgttagccaggatggtctcgatctcctgacctcgggatccgcctaccttggcctcccaaagtgctgggattacaggcgtgagccactgtgctaggccc

SEQ ID NO: 77501 - DNA, 601 bp, Human
tattattgaatttttttactaatatttgttgaggatttttacatctatgttcatgagtgatattggtctacatttttttgttattgtaatatcttggattttagtatcagggtaatgctggcctcatggaataagatagaaagtattcctgatgcttttatcctgtgaagaaggttgtatacaattagtataacatgtttcttaaatgtttggtataattcaccagtgaaactatctgggcctcattctttctgttttttgttttgttttgtttttttgagatggagtctcgctctgttayccaggctggagtgcagtggtgctgtctcagctcactgcaacctctgcctccctggttcatgccattctcctgcctcagcctcctgagtagctgggactacaggcacccaccaccacgcctggctaattttttgtatttttactagagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatt

SEQ ID NO: 77502 - DNA, 601 bp, Human
ctccctggttcatgccattctcctgcctcagcctcctgagtagctgggactacaggcacccaccaccacgcctggctaattttttgtatttttactagagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatttcttaaacagataaaggcctaattcagatcatcagttttttcttgtargagtttgagtagattgtttattttgggaaattggtcgatttaatttaggttattataattgcaggtatagttttttcatagtatttcattattatctttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaat

SEQ ID NO: 77503 - DNA, 601 bp, Human
acgcctggctaattttttgtatttttactagagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatttcttaaacagataaaggcctaattcagatcatcagttttttcttgtaggagtttgagtagattgtttattttgggaaattggtcgatttaatttaggttattataattgcaggtrtagttttttcatagtatttcattattatctttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaagg

SEQ ID NO: 77504 - DNA, 601 bp, Human
gagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatttcttaaacagataaaggcctaattcagatcatcagttttttcttgtaggagtttgagtagattgtttattttgggaaattggtcgatttaatttaggttattataattgcaggtatagttttttcatagtatttcattattatcyttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaaggtagaaacttaaatactgattttaaatgttt

SEQ ID NO: 77505 - DNA, 601 bp, Human
aatttaggttattataattgcaggtatagttttttcatagtatttcattattatctttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttkctgtttttttccaagtttcctaaggtagaaacttaaatactgattttaaatgtttcctcttttctcatatatgtattcagtgtaataaattttcctctaagcattgcttttgctacctcccacaaactttgatgaattgtgtttttatttttatttagtcaaaatatttaaaaacttatcttgagatttcctttgacctaaatgttacttaaaaatgtgttacttagtctctacatatttggggatttttccagttatttctgttattgattctactttaattctattgttgtctgagaa

SEQ ID NO: 77506 - DNA, 601 bp, Human
tatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaaggtagaaacttaaatactgattttaaatgtttcctcttttctcatatatgtattcagtgyaataaattttcctctaagcattgcttttgctacctcccacaaactttgatgaattgtgtttttatttttatttagtcaaaatatttaaaaacttatcttgagatttcctttgacctaaatgttacttaaaaatgtgttacttagtctctacatatttggggatttttccagttatttctgttattgattctactttaattctattgttgtctgagaacaaatgctatcacttctttttgaaaataaattggataagatatattttatggcttagaatgtggtctttcttggtgaatgttc

SEQ ID NO: 77507 - DNA, 601 bp, Human
tctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaaggtagaaacttaaatactgattttaaatgtttcctcttttctcatatatgtattcagtgtaataaattttcctctaagcattgcttttgctacctcccacraactttgatgaattgtgtttttatttttatttagtcaaaatatttaaaaacttatcttgagatttcctttgacctaaatgttacttaaaaatgtgttacttagtctctacatatttggggatttttccagttatttctgttattgattctactttaattctattgttgtctgagaacaaatgctatcacttctttttgaaaataaattggataagatatattttatggcttagaatgtggtctttcttggtgaatgttccatgtgagcttaagaatgtctattctactgttgttggatgt

SEQ ID NO: 77508 - DNA, 601 bp, Human
gatttgttcccttcccacagaggagtattgatgtctccaactatgatagtgtattcatctatttctccttgcagttctaccagtttttacttcatagaatttgatgctctgttgttgggtgcatatatgttaaggagtattatatcttttttgagaactgatgtccttattattctgtaatgccccctcccacctttttttttaaatcaatttccttttgcttttctttttttttaaattttattattattatactttaagttttagggtacatgtgcacaacatgcaggtttgttacatwtgtatacctttttttaacctctggtaactttccttgctttgaagtttgctgtgtctaaaattaatatagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgca

SEQ ID NO: 77509 - DNA, 601 bp, Human
ccttgcagttctaccagtttttacttcatagaatttgatgctctgttgttgggtgcatatatgttaaggagtattatatcttttttgagaactgatgtccttattattctgtaatgccccctcccacctttttttttaaatcaatttccttttgcttttctttttttttaaattttattattattatactttaagttttagggtacatgtgcacaacatgcaggtttgttacatttgtatacctttttttaacctctggtaactttccttgctttgaagtttgctgtgtctaaaattaatwtagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgcattctgagaagtgcactgtcatacaaattttttaattttgcaaacatcatagactgtacttacacaa

SEQ ID NO: 77510 - DNA, 601 bp, Human
ctggtaactttccttgctttgaagtttgctgtgtctaaaattaatatagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgcattctgagaagtgcactgtcakacaaattttttaattttgcaaacatcatagactgtacttacacaagcctagatagattagcctgctagacacctaggctatatgttatagcctattgctttgaggctacaaacctttacagcctgttattgtactaaatactgcaggaattgtaacacaataagtatttttgtatctaagcatagaaaaagtacagtaaaatatggtgttataatctaatgggaccactatcatatatgcagtccactggtaactaaaatgtcatcatgtggtacatgattgtagttgaattaatatcta

SEQ ID NO: 77511 - DNA, 601 bp, Human
tgtctaaaattaatatagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgcattctgagaagtgcactgtcatacaaattttttaattttgcaaacatcatagwctgtacttacacaagcctagatagattagcctgctagacacctaggctatatgttatagcctattgctttgaggctacaaacctttacagcctgttattgtactaaatactgcaggaattgtaacacaataagtatttttgtatctaagcatagaaaaagtacagtaaaatatggtgttataatctaatgggaccactatcatatatgcagtccactggtaactaaaatgtcatcatgtggtacatgattgtagttgaattaatatctaccatacttcttactgtatttctgtcttgttc

SEQ ID NO: 77512 - DNA, 601 bp, Human
ggaattacttatttctgctacaatattttgatctctagcatttgtttttggttctttcttagaatttttatctcggcttaaattgctcatctgttcttgcatactgtctcttttacttttatagcccttagcatgttgctcatagtcattttaaattcccagtctgataattccaacatctctgccatatgtgagtttggtcctgattcttgctctgtctcttctaattgtgttatttgccttttaggtgacttgtaatatctccttgatagcaagggaggatgtattggataaaaacctrctatacatgtgccttcaataatgtgttggtaaggcacagtccggagaagaggcatcctacagttccaagcttaggtatcagtctttgaatgaacctctgactctggaccataaatttcacaaatgcttctcaatttttttttttttttttttgagatggagtctcactctgttgcccaggctggaatgcagtggtgtgatcttagctcactacagcctctccctccctggttcaagcaattctctgcctcagcctcccagtagctgagattacaggcactcaacaccacacccagctaat

SEQ ID NO: 77513 - DNA, 601 bp, Human
tattggataaaaacctgctatacatgtgccttcaataatgtgttggtaaggcacagtccggagaagaggcatcctacagttccaagcttaggtatcagtctttgaatgaacctctgactctggaccataaatttcacaaatgcttctcaatttttttttttttttttttgagatggagtctcactctgttgcccaggctggaatgcagtggtgtgatcttagctcactacagcctctccctccctggttcaagcaattctctgcctcagcctcccagtagctgagattacaggcactcaayaccacacccagctaatttttttgtattttttagtagagacggggtttcaccatcttggccaggctggtcttgaactcctgacctcacaatccaccagcttcatcttcccaaagtgtcaatttttaaaaaaatgtttttctccctaggcaggataggatggctagagtgggctgtaattgaatatttctctctgtaatatggtaggctagaactggctgaagttgggtatttcctttacctcaggtcagttaagcttagataacaccagagcttatgaggctccaattaattagtttttcc

SEQ ID NO: 77514 - DNA, 601 bp, Human
tttgagatggagtctcactctgttgcccaggctggaatgcagtggtgtgatcttagctcactacagcctctccctccctggttcaagcaattctctgcctcagcctcccagtagctgagattacaggcactcaacaccacacccagctaatttttttgtattttttagtagagacggggtttcaccatcttggccaggctggtcttgaactcctgacctcacaatccaccagcttcatcttcccaaagtgtcaatttttaaaaaaatgtttttctccctaggcaggataggatggctagartgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatgattgctttctctttcactctgctagaatgagaagatttttctccaacatttactataagatccaggtcgagctcctgaagagaaaatcatcaaaaaaggggatccttg

SEQ ID NO: 77515 - DNA, 601 bp, Human
gccaggctggtcttgaactcctgacctcacaatccaccagcttcatcttcccaaagtgtcaatttttaaaaaaatgtttttctccctaggcaggataggatggctagagtgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatrattgctttctctttcactctgctagaatgagaagatttttctccaacatttactataagatccaggtcgagctcctgaagagaaaatcatcaaaaaaggggatccttgaattggtccccctggagttattagccctcagacttgtccaacctgaggctctagcaattcaattatagtacatttttttttcttttttaccctagcactatttcctttctggtttttgttatgagtttctgctccaggaagctgttactccttatatttactttgtctctccatctccaatcttggagacag

SEQ ID NO: 77516 - DNA, 601 bp, Human
ggctggtcttgaactcctgacctcacaatccaccagcttcatcttcccaaagtgtcaatttttaaaaaaatgtttttctccctaggcaggataggatggctagagtgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatgattsctttctctttcactctgctagaatgagaagatttttctccaacatttactataagatccaggtcgagctcctgaagagaaaatcatcaaaaaaggggatccttgaattggtccccctggagttattagccctcagacttgtccaacctgaggctctagcaattcaattatagtacatttttttttcttttttaccctagcactatttcctttctggtttttgttatgagtttctgctccaggaagctgttactccttatatttactttgtctctccatctccaatcttggagacagtggt

SEQ ID NO: 77517 - DNA, 601 bp, Human
gctagagtgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatgattgctttctctttcactctgctagaatgagaagatttttctccaacatttactataagatccaggtcgagctcctgaagagaaaatcatcaaaaaaggggrtccttgaattggtccccctggagttattagccctcagacttgtccaacctgaggctctagcaattcaattatagtacatttttttttcttttttaccctagcactatttcctttctggtttttgttatgagtttctgctccaggaagctgttactccttatatttactttgtctctccatctccaatcttggagacagtggtttgccacatgtcctcatctcttttatggatccaagaatcattgctttttcagtcggtttagtgttttacttgatgttagaaaaaaatggcgccctcca

SEQ ID NO: 77518 - DNA, 601 bp, Human
actttcttttctgcaaaagtagcacccagaagtcccagtatattttttaaaattgtattcacttatctcatgtcttatcagtcctaaacttgtacttaaaattccactataatttcttaattaatacacaagttatttaaaataagatttgccccaaatatgtagggattcttatttaaaaatgttttctaccattgcctgccataattgcactgtggcagatattgtctgtacgatacctactttttgcaacctgttgagttctctttttcttttcaacttttattttaggttcaggggktacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccgaatatatcatcagtttttgtaattctccctcatgtacttgagaaaaatgcatattctttgaattgttggatgtagtttttttttttttttttt

SEQ ID NO: 77519 - DNA, 601 bp, Human
ttgcactgtggcagatattgtctgtacgatacctactttttgcaacctgttgagttctctttttcttttcaacttttattttaggttcagggggtacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccraatatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgtcgcccagtttcaagtgaggttcaagtgattttcctgcctcagcctcctgagtagctgggattacaggcacatgccactgtgcctggctaatttttgtatttttagtagagactgggtttcaccgtattggtcaggct

SEQ ID NO: 77520 - DNA, 601 bp, Human
tgcactgtggcagatattgtctgtacgatacctactttttgcaacctgttgagttctctttttcttttcaacttttattttaggttcagggggtacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccgratatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgtcgcccagtttcaagtgaggttcaagtgattttcctgcctcagcctcctgagtagctgggattacaggcacatgccactgtgcctggctaatttttgtatttttagtagagactgggtttcaccgtattggtcaggctg

SEQ ID NO: 77521 - DNA, 601 bp, Human
tattttaggttcagggggtacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccgaatatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgtcgcccagtttcaagtgaggttcaagtgattttcctgcctcagcctcctgagtagctgggattacaggcacatgccactgtgcctggctaatttttgtatttttagtagagactgggtttcaccgtattggtcaggctggtcttgaactcctgacctcgtgatccacctgccttggcctcacaaagtgctgggattacaggcatgagccaccat

SEQ ID NO: 77522 - DNA, 601 bp, Human
ctcagataataatcatagttaccaacaggtacttttttagatttcaccctcctcctaccctccaccctcaagtaggcctcagcatctattgttcacctgtttgtgtccatgtgtactgttgggatttttttatgtccgaatatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgycgcccagtttcaagtgaggttcaagtgattttcctgcctcagcctcctgagtagctgggattacaggcacatgccactgtgcctggctaatttttgtatttttagtagagactgggtttcaccgtattggtcaggctggtcttgaactcctgacctcgtgatccacctgccttggcctcacaaagtgctgggattacaggcatgagccaccatgcccaaccagatgtagaattttatatgaattttatatgtatcttagaggtcagtcttgttaattgtgttattcaggtcttttatgtt

SEQ ID NO: 77523 - DNA, 601 bp, Human
tgcctcagcctcctgagtagctgggattacaggcacatgccactgtgcctggctaatttttgtatttttagtagagactgggtttcaccgtattggtcaggctggtcttgaactcctgacctcgtgatccacctgccttggcctcacaaagtgctgggattacaggcatgagccaccatgcccaaccagatgtagaattttatatgaattttatatgtatcttagaggtcagtcttgttaattgtgttattcaggtcttttatgttcttgctaatattttgactacttgacctatcataaytgagaaacaaagatatgttgaaatttcctctagtgacaataattctactgacttttgtttatatattttatacctattaaatccattgttttataatcattgtatcttttaggttgatatatcaatatgtagaaacctctatccataatgatgtttatgtaaatctatttgggctattatttatacagctacaagtttttttttaattgcttcttattcttttaccatcatcaacacttcctcatgaattaggaatacctgttatcaagatcgcatatttagatttttcaaaaaatagcc

SEQ ID NO: 77524 - DNA, 601 bp, Human
attttatatgaattttatatgtatcttagaggtcagtcttgttaattgtgttattcaggtcttttatgttcttgctaatattttgactacttgacctatcataattgagaaacaaagatatgttgaaatttcctctagtgacaataattctactgacttttgtttatatattttatacctattaaatccattgttttataatcattgtatcttttaggttgatatatcaatatgtagaaacctctatccataatgatgtttatgtaaatctatttgggctattatttatacagctacaagattttttttaattgcttcttattcttttaccatcatcaacacttcctcatgaattaggaatacctgttatcaagatcgcatatttagatttttcaaaaaatagccaaactgaaaaatctctgcctttaaactagcaattttgtccacttacgtttattgtattttatatagtcagacttgtttctactatcttagaatattatgccaatttactcccttccctgttgccttttaatgttttcttatactttttgaattgatatatttatctctcttacaacaaggcaaatactgtagcata

SEQ ID NO: 77525 - DNA, 601 bp, Human
aattaggaatacctgttatcaagatcgcatatttagatttttcaaaaaatagccaaactgaaaaatctctgcctttaaactagcaattttgtccacttacgtttattgtattttatatagtcagacttgtttctactatcttagaatattatgccaatttactcccttccctgttgccttttaatgttttcttatactttttgaattgatatatttatctctcttacaacaaggcaaatactgtagcatattgctatggtctgaatatttgtactgtctctgatccaaaggtaaagacttygagaagtgattaggtcatgaaagcagacccctcatgaatgggcttagtgtttttataaaagagaccccagagagctattttgcccttcccactgtgagattactgtaagaagatggccctcttcctgctgctgtcctgatctcagacttttcaacctctggaactgtgacaagtaaatttctgttgtttataaggtactcagttttgttgtatgctatattttgctatatttttaatagaagccccaaacatactaaaatacatgttctcatgttctttgatacgcctctttaaccttta

SEQ ID NO: 77526 - DNA, 601 bp, Human
cagagagctattttgcccttcccactgtgagattactgtaagaagatggccctcttcctgctgctgtcctgatctcagacttttcaacctctggaactgtgacaagtaaatttctgttgtttataaggtactcagttttgttgtatgctatattttgctatatttttaatagaagccccaaacatactaaaatacatgttctcatgttctttgatacgcctctttaacctttatactctctgatactatctcgattttccatctaaaattttaaattttagatattatatctattttcttyccttttctatttttggtctcattttttaaaagacaattacaaaattatcaagtgttttattcaccttgttttacaaatctcacacaatatcttcagtatttgattcttgttttattgaagtatatcttccgaatttgatttcagtgtgtatctttacatgccacacttttgagaccttatatgctcaataatatatttccttatagttgaatgactacatggctaaatataaaattacagttttaatgttctcttacctcaatacttcaaaagtattattcatccacggggctcatgcct

SEQ ID NO: 77527 - DNA, 601 bp, Human
ctgctgctgtcctgatctcagacttttcaacctctggaactgtgacaagtaaatttctgttgtttataaggtactcagttttgttgtatgctatattttgctatatttttaatagaagccccaaacatactaaaatacatgttctcatgttctttgatacgcctctttaacctttatactctctgatactatctcgattttccatctaaaattttaaattttagatattatatctattttctttccttttctatttttggtctcattttttaaaagacaattacaaaattatcaagtgttytattcaccttgttttacaaatctcacacaatatcttcagtatttgattcttgttttattgaagtatatcttccgaatttgatttcagtgtgtatctttacatgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgacgtgggtggatcacaagatcaggagattgag

SEQ ID NO: 77528 - DNA, 601 bp, Human
atattttgctatatttttaatagaagccccaaacatactaaaatacatgttctcatgttctttgatacgcctctttaacctttatactctctgatactatctcgattttccatctaaaattttaaattttagatattatatctattttctttccttttctatttttggtctcattttttaaaagacaattacaaaattatcaagtgttttattcaccttgttttacaaatctcacacaatatcttcagtatttgattcttgttttattgaagtatatcttccgaatttgatttcagtgtgwatctttacatgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgacgtgggtggatcacaagatcaggagattgagaccatcctggctaacatggtgaaaccccgtctctactaaaaatacaaaaaaattagctgggtgtggtggtgggcacctatagtcccagctac

SEQ ID NO: 77529 - DNA, 601 bp, Human
tatatttttaatagaagccccaaacatactaaaatacatgttctcatgttctttgatacgcctctttaacctttatactctctgatactatctcgattttccatctaaaattttaaattttagatattatatctattttctttccttttctatttttggtctcattttttaaaagacaattacaaaattatcaagtgttttattcaccttgttttacaaatctcacacaatatcttcagtatttgattcttgttttattgaagtatatcttccgaatttgatttcagtgtgtatctttacrtgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgacgtgggtggatcacaagatcaggagattgagaccatcctggctaacatggtgaaaccccgtctctactaaaaatacaaaaaaattagctgggtgtggtggtgggcacctatagtcccagctactcaggaggc

SEQ ID NO: 77530 - DNA, 601 bp, Human
taaaagacaattacaaaattatcaagtgttttattcaccttgttttacaaatctcacacaatatcttcagtatttgattcttgttttattgaagtatatcttccgaatttgatttcagtgtgtatctttacatgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgasgtgggtggatcacaagatcaggagattgagaccatcctggctaacatggtgaaaccccgtctctactaaaaatacaaaaaaattagctgggtgtggtggtgggcacctatagtcccagctactcaggaggctgaggcaggagaatggcatgaaccctggaggcggagcttgcagtgagctgagattgtgtcactgcactccagcctgggcaacagagtgagactctgtctcaaaaaaaaaaaaaagtactattaatcttttgtacatccacacttactgtttaaaattgatatgctttct

SEQ ID NO: 77531 - DNA, 601 bp, Human
atgaaccctggaggcggagcttgcagtgagctgagattgtgtcactgcactccagcctgggcaacagagtgagactctgtctcaaaaaaaaaaaaaagtactattaatcttttgtacatccacacttactgtttaaaattgatatgctttcttttctgaaagacttcaaatttttttcttgtcattgatattcttatctaaactttctccatatatatgtgtgtccctatgtcttttgctgggtgttcaacaggcactctcaatctgaggttttcacatttttgttgaatattggaaaatktgcatttattttattttttaaattttctcctcttcaacttattatactccttttaaggaattcattattaagttattgttaattttaattaaaatctttgtacactttaaacatatatatatagtatataagttgtgtgtatatatatgtgtgtgtgtgtatatatacaccttaaactttgtataccttaaacttaaagatatttatatatacataagtgtaagttatataaagataccttacatatatatatgtatgtatttccaaatttttaaataaaatttctggccaggcgcagtg

SEQ ID NO: 77532 - DNA, 601 bp, Human
tagtatataagttgtgtgtatatatatgtgtgtgtgtgtatatatacaccttaaactttgtataccttaaacttaaagatatttatatatacataagtgtaagttatataaagataccttacatatatatatgtatgtatttccaaatttttaaataaaatttctggccaggcgcagtggctcctccgtgtaatcccagcactttggaaggctgaggtgggcgaatcacttgaggttgggagttcaggaccagcctggccaaggttgtgaaaccccctctctactaaaatacaaaaattakccaggcatggtggcatatacccctgtagtaccagttacttgggaagctgagacaggaggatcacttgaacctacgaggcagtggttgcagtgagccgagatcacaccattgcactccagcctggttgacagagcaagcatctgtctcaaagaaaaaaaaaattccatcttgcattaattgataacccccaaatcattcaggagcagattgtttattttccatgtatttgtgtagttttaggagttccttctggagttgatttctagttttattccactatggtctgaaaaaaatagttga

SEQ ID NO: 77533 - DNA, 601 bp, Human
tgagccgagatcacaccattgcactccagcctggttgacagagcaagcatctgtctcaaagaaaaaaaaaattccatcttgcattaattgataacccccaaatcattcaggagcagattgtttattttccatgtatttgtgtagttttaggagttccttctggagttgatttctagttttattccactatggtctgaaaaaaatagttgatatgatttcaattaaaaaaaattattcggccaggtgtggtagctcatgcctgtaatcccagcactttgggaggccaaggtgggcgaatcayctgaggccaggaattcaagaccagcctggccaacatggtgaaaccacatctctattaaaaatacaaaaattagccaggtgtggtggtgcatgcctgtaatctcagctactcgggaggctgaggcaggagaattgcttgaacccgggaggcagaagttgcagtgagccaagattgtgtcactgcactccagtccatgtgacagagcaagactgtctcaaaaaaaaaaaaaaaaaaaagcaccagttctatccctctaagtttcagagatggattcattgctaaccaaggtgatggaagcca

SEQ ID NO: 77534 - DNA, 601 bp, Human
tgaaaaaaatagttgatatgatttcaattaaaaaaaattattcggccaggtgtggtagctcatgcctgtaatcccagcactttgggaggccaaggtgggcgaatcatctgaggccaggaattcaagaccagcctggccaacatggtgaaaccacatctctattaaaaatacaaaaattagccaggtgtggtggtgcatgcctgtaatctcagctactcgggaggctgaggcaggagaattgcttgaacccgggaggcagaagttgcagtgagccaagattgtgtcactgcactccagtccrtgtgacagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtatgattctaccagctttctgacctctgacctcttggaaagagcagccccagttagtgaaaaggtttgaccctgat

SEQ ID NO: 77535 - DNA, 601 bp, Human
caaaaattagccaggtgtggtggtgcatgcctgtaatctcagctactcgggaggctgaggcaggagaattgcttgaacccgggaggcagaagttgcagtgagccaagattgtgtcactgcactccagtccatgtgacagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgkacaaggtagccacatgggagaagcagatctacacatactgttaagatggtcttgtatgattctaccagctttctgacctctgacctcttggaaagagcagccccagttagtgaaaaggtttgaccctgatcaacaatgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaac

SEQ ID NO: 77536 - DNA, 601 bp, Human
aggcaggagaattgcttgaacccgggaggcagaagttgcagtgagccaagattgtgtcactgcactccagtccatgtgacagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtaygattctaccagctttctgacctctgacctcttggaaagagcagccccagttagtgaaaaggtttgaccctgatcaacaatgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaactcaccccagcaacacagggcaaggatatagatgcttcagtttgttcttttgtgttaa

SEQ ID NO: 77537 - DNA, 601 bp, Human
acagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtatgattctaccagctttctgacctctgacctcttggaaagagcagccccagttagtgaaaaggtttgaccctgatcaacmatgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaactcaccccagcaacacagggcaaggatatagatgcttcagtttgttcttttgtgttaaatgtttacaaggacctcagaactaaagcctgttctctggaggaaataaagaaaatatgtttggaggtgcctgaatatg

SEQ ID NO: 77538 - DNA, 601 bp, Human
cagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtatgattctaccagctttctgacctctgacctcttggaaagagcagccccagttagtgaaaaggtttgaccctgatcaacawtgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaactcaccccagcaacacagggcaaggatatagatgcttcagtttgttcttttgtgttaaatgtttacaaggacctcagaactaaagcctgttctctggaggaaataaagaaaatatgtttggaggtgcctgaatatga

SEQ ID NO: 77539 - DNA, 601 bp, Human
gagtgtagtttaagtacattgtttttgttgactttctctctagatcatctgtctagtgcggtcagtgaagtttttaagttctccactataattgtgttgctgtctactgatttcttaggtctagtagtaattgttttatgaatctgggagctccattgttaggtgcataaaaatttaatctttttttgttggattgatttcttctatcattatataatcatcttccttgtcttttttttttttaactgttgttccattctgtggaaatcgaaatcaaaaagtgagcaggagctattcttayatcagataaaacagactttaaagcaacaacagttacacatatttatttcacatattccaattttttttcattttcatagcttacttcctttggtaacattcactatattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattc

SEQ ID NO: 77540 - DNA, 601 bp, Human
taattgtgttgctgtctactgatttcttaggtctagtagtaattgttttatgaatctgggagctccattgttaggtgcataaaaatttaatctttttttgttggattgatttcttctatcattatataatcatcttccttgtcttttttttttttaactgttgttccattctgtggaaatcgaaatcaaaaagtgagcaggagctattcttacatcagataaaacagactttaaagcaacaacagttacacatatttatttcacatattccaattttttttcattttcatagcttacttcytttggtaacattcactatattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattcttccaaagagtgttattctttagttagttagttagtttctttgttttataaggtatttaacttcgttgacttggaattgcaaactatg

SEQ ID NO: 77541 - DNA, 601 bp, Human
gtctactgatttcttaggtctagtagtaattgttttatgaatctgggagctccattgttaggtgcataaaaatttaatctttttttgttggattgatttcttctatcattatataatcatcttccttgtcttttttttttttaactgttgttccattctgtggaaatcgaaatcaaaaagtgagcaggagctattcttacatcagataaaacagactttaaagcaacaacagttacacatatttatttcacatattccaattttttttcattttcatagcttacttcctttggtaacattyactatattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattcttccaaagagtgttattctttagttagttagttagtttctttgttttataaggtatttaacttcgttgacttggaattgcaaactatgtgttggtgtttta

SEQ ID NO: 77542 - DNA, 601 bp, Human
actgatttcttaggtctagtagtaattgttttatgaatctgggagctccattgttaggtgcataaaaatttaatctttttttgttggattgatttcttctatcattatataatcatcttccttgtcttttttttttttaactgttgttccattctgtggaaatcgaaatcaaaaagtgagcaggagctattcttacatcagataaaacagactttaaagcaacaacagttacacatatttatttcacatattccaattttttttcattttcatagcttacttcctttggtaacattcactrtattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattcttccaaagagtgttattctttagttagttagttagtttctttgttttataaggtatttaacttcgttgacttggaattgcaaactatgtgttggtgttttaatca

SEQ ID NO: 77543 - DNA, 601 bp, Human
atttaacttcgttgacttggaattgcaaactatgtgttggtgttttaatcagctcaggtgctaaaacaaaaaccatcaacatatatatttgaaggatatgcaaacattcagtccttaacagatggtaataaaaacaatgacaatgagtgagtttgcccagaaaaagtatatgaagtaaaaagaggagagtgtctgaaacaaatccctggaagaacaggggataaccagaataacataatccatggatacttgtgaggaatgatgcaaaaaacaggatttgagtcatgcaggtgtagtcaastctaagcttctactggaaaggacacaaaggagagttatgggaaagagaaggttcagtggggcaggggagttattttttaaaataaaataaactgtagaagcttagaactgtcttctgactgtaagtccagaaattttaccgtattacactaatgaacagcttgccgtgactgcaggtagatagagactttacctcttatctcgatgccagttgtctcttcctgccagtgacacattaaaatctctctgacaattatgtacatttgtatctctgttttgtttttatttgaatgaacttaaa

SEQ ID NO: 77544 - DNA, 601 bp, Human
aagaggagagtgtctgaaacaaatccctggaagaacaggggataaccagaataacataatccatggatacttgtgaggaatgatgcaaaaaacaggatttgagtcatgcaggtgtagtcaactctaagcttctactggaaaggacacaaaggagagttatgggaaagagaaggttcagtggggcaggggagttattttttaaaataaaataaactgtagaagcttagaactgtcttctgactgtaagtccagaaattttaccgtattacactaatgaacagcttgccgtgactgcaggtaratagagactttacctcttatctcgatgccagttgtctcttcctgccagtgacacattaaaatctctctgacaattatgtacatttgtatctctgttttgtttttatttgaatgaacttaaagcagagagctggaggttggtagttcacaattttaataaaaatagaaatttatcaagcttactgtgaagctagcacttcatgttcctggaggtatttagaaagcctcgcatatgcccagggtagtagactcacttgtaaaacacctgagaagaccataagcttttacctaaggctgatcc

SEQ ID NO: 77545 - DNA, 601 bp, Human
tttttaaaataaaataaactgtagaagcttagaactgtcttctgactgtaagtccagaaattttaccgtattacactaatgaacagcttgccgtgactgcaggtagatagagactttacctcttatctcgatgccagttgtctcttcctgccagtgacacattaaaatctctctgacaattatgtacatttgtatctctgttttgtttttatttgaatgaacttaaagcagagagctggaggttggtagttcacaattttaataaaaatagaaatttatcaagcttactgtgaagctagcrcttcatgttcctggaggtatttagaaagcctcgcatatgcccagggtagtagactcacttgtaaaacacctgagaagaccataagcttttacctaaggctgatcctcaggctcagcccaaggcttaccaaaggcggaagaattaaaaaaaaaatagctaaaataaaaatttataagaaaagagttatggactgaatatttgtgccttccttgccaattacatattgaaaccctgagcccaaggtgttggtatttgaggcctttggcaggtaaatagatcatgagagaggaacccttcatg

SEQ ID NO: 77546 - DNA, 601 bp, Human
cagttgtctcttcctgccagtgacacattaaaatctctctgacaattatgtacatttgtatctctgttttgtttttatttgaatgaacttaaagcagagagctggaggttggtagttcacaattttaataaaaatagaaatttatcaagcttactgtgaagctagcacttcatgttcctggaggtatttagaaagcctcgcatatgcccagggtagtagactcacttgtaaaacacctgagaagaccataagcttttacctaaggctgatcctcaggctcagcccaaggcttaccaaaggyggaagaattaaaaaaaaaatagctaaaataaaaatttataagaaaagagttatggactgaatatttgtgccttccttgccaattacatattgaaaccctgagcccaaggtgttggtatttgaggcctttggcaggtaaatagatcatgagagaggaacccttcatgatgggatttgtgcccttagataatgtgagaaagccaactaaatttttccctccctgtgagggtacgagtagaagctagctgtcttcaacctaaaagagggccttcaccagaattcaactgtgttggccccttga

SEQ ID NO: 77547 - DNA, 601 bp, Human
cccttatgattagtgatgttgagcatcttttcatatgtttattggccatttatacatcttgtttggagaaatgtttattcaagtcctttgtccattttttagttgcattatttgttttttgttgttgttaagttgcagaagttacttatatattctgggtattagctccttattaaatatgggatttgcaattattttctgccattctataggttaaattttcatcttgtttctttttatgtgcagaggtctttaagtttgatgtagtcacatttgtctattttttattttgttgcctgtsctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccat

SEQ ID NO: 77548 - DNA, 601 bp, Human
cattatttgttttttgttgttgttaagttgcagaagttacttatatattctgggtattagctccttattaaatatgggatttgcaattattttctgccattctataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattct

SEQ ID NO: 77549 - DNA, 601 bp, Human
aaatatgggatttgcaattattttctgccattctataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatayccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctattt

SEQ ID NO: 77550 - DNA, 601 bp, Human
tgccattctataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttraagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatgg

SEQ ID NO: 77551 - DNA, 601 bp, Human
ataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcata

SEQ ID NO: 77552 - DNA, 601 bp, Human
ggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggtyctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcatacct

SEQ ID NO: 77553 - DNA, 601 bp, Human
tactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgaytatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacggcaagatgccacatcttta

SEQ ID NO: 77554 - DNA, 601 bp, Human
aagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaarcaggaaatatgaagcatccagctgtgttattcttcaagattattttggctacgcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacggcaagatgccacatctttaaaaaaaaataattagttaggcatagtggtgcacagctgtagtaccagctattgaggagg

SEQ ID NO: 77555 - DNA, 601 bp, Human
attccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacrgcaagatgccacatctttaaaaaaaaataattagttaggcatagtggtgcacagctgtagtaccagctattgaggaggctgaggtgggaggattgatagagcccaagaggttgggactgcagtgagccatgatcactccattgtactccagactgggcaacagagcaagactctgtaaaaattcaaaatttaaaaaattaaatggcattgaaattaaaatctgtagatgagtttggatagtatggatgttttaacaatactaaatcttccaatctatgagaattgaatgtttcccattta

SEQ ID NO: 77556 - DNA, 601 bp, Human
gcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacggcaagatgccacatctttaaaaaaaaataattagttaggcatagtggtgcacagctgtagtaccagctattgaggaggctgaggtgggaggattgatagagcccaagaggttgggactgcagtgagccatkatcactccattgtactccagactgggcaacagagcaagactctgtaaaaattcaaaatttaaaaaattaaatggcattgaaattaaaatctgtagatgagtttggatagtatggatgttttaacaatactaaatcttccaatctatgagaattgaatgtttcccatttatttgtgttttatttattttggtaatatttaataggtttcagtgtaaaaatcttcactttgtcatttaagtttattcctaagtgttttatcttttttatgatctagtgagattttcttaatttccttttgaa

SEQ ID NO: 77557 - DNA, 601 bp, Human
ttccaatctatgagaattgaatgtttcccatttatttgtgttttatttattttggtaatatttaataggtttcagtgtaaaaatcttcactttgtcatttaagtttattcctaagtgttttatcttttttatgatctagtgagattttcttaatttccttttgaaatgttcattggtagtgcatagaaacacttcttaattttgaatgttgatttgtgtcctgcaactttgctaaatgtgtttattttttctaaattttttttggtagaatctttacatataagatgatgtcatctgtgarcagagataattttatttcttttccaatctgaatgcattttatttctttttcttgtttaatttcttttcctagaacttccagcagtaggttgaattaatattaatgttaggagtgggcatcttgtcaaatgttttttctgcattaattgagatgatcatgtggttttgtccttcattttgtgaatgtgatgtattatgctgatttaattttgtatgttaaaccatccttgtattccaggtatatattttgctggatcatgatgtgattttttaaaatatgctgttgaattcagtctgctag

SEQ ID NO: 77558 - DNA, 601 bp, Human
gtgcatagaaacacttcttaattttgaatgttgatttgtgtcctgcaactttgctaaatgtgtttattttttctaaattttttttggtagaatctttacatataagatgatgtcatctgtgaacagagataattttatttcttttccaatctgaatgcattttatttctttttcttgtttaatttcttttcctagaacttccagcagtaggttgaattaatattaatgttaggagtgggcatcttgtcaaatgttttttctgcattaattgagatgatcatgtggttttgtccttcatttwgtgaatgtgatgtattatgctgatttaattttgtatgttaaaccatccttgtattccaggtatatattttgctggatcatgatgtgattttttaaaatatgctgttgaattcagtctgctagtattacatttaggatttttgtatcaatattcaccaggaatatttttctgtagttttctttttttctgtctttatgttattttggtattagggtaattctggccacattaagtgaattttggagtttctttcaaaagtattggtgttacttattctttaggagtttggtaaaattctct

SEQ ID NO: 77559 - DNA, 601 bp, Human
tttcttttccaatctgaatgcattttatttctttttcttgtttaatttcttttcctagaacttccagcagtaggttgaattaatattaatgttaggagtgggcatcttgtcaaatgttttttctgcattaattgagatgatcatgtggttttgtccttcattttgtgaatgtgatgtattatgctgatttaattttgtatgttaaaccatccttgtattccaggtatatattttgctggatcatgatgtgattttttaaaatatgctgttgaattcagtctgctagtattacatttaggakttttgtatcaatattcaccaggaatatttttctgtagttttctttttttctgtctttatgttattttggtattagggtaattctggccacattaagtgaattttggagtttctttcaaaagtattggtgttacttattctttaggagtttggtaaaattctctagtgaagacattggttactggttttatcttttttggaagtatttgatactgcttcaatgtcctaattatagttctgttcagatttttaaaattgaatcataattcaattttagtaggttgtatgtttctaggaatgt

SEQ ID NO: 77560 - DNA, 601 bp, Human
tattcatttattctatgttttccagtttgttggcttataattgttcatagtcatctcttataattctttttaatttctgagacagccgttgtaatgcctgctctttcagttctaattttagctatttaagtctctctctcttttttattttagctaaaggtctctcagttttgttgatatattcaaaagaccaacttgggttcattaatttttttctgttgtttttgtttattttctattttattttttctactctaatgtttaatattttcttcgtctcttaatttcaggtttgtttttrttttcctggttccttgatggatacagttatgttatttatttgagatttttctttccttaatatcaatttataaactttccctttagtgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataa

SEQ ID NO: 77561 - DNA, 601 bp, Human
agacagccgttgtaatgcctgctctttcagttctaattttagctatttaagtctctctctcttttttattttagctaaaggtctctcagttttgttgatatattcaaaagaccaacttgggttcattaatttttttctgttgtttttgtttattttctattttattttttctactctaatgtttaatattttcttcgtctcttaatttcaggtttgtttttgttttcctggttccttgatggatacagttatgttatttatttgagatttttctttccttaatatcaatttataaactttmcctttagtgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataattacaacatttttaatttgttaagatttgttgtgtgggccacggtggtctatcttggagaatgttccatttctgctgga

SEQ ID NO: 77562 - DNA, 601 bp, Human
agatttttctttccttaatatcaatttataaactttccctttagtgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataattacaacatttttaatttgttaagatttgttgtgtgggccacrgtggtctatcttggagaatgttccatttctgctggagaaaagatgtattctgttgttatttgatagagagtgctctatttgtctgttaggttaattggtctatcatgttcaagtcatttgattcctatgatagtctccctggttgttctgtatatgaatgaatgcaggatattgaagtatcattttattattattattattatgttactgtccatttttccttcagttgtatctatgtttgtttcatatatctcattgctttagttttaggtgcagatctatttataattgttggctctt

SEQ ID NO: 77563 - DNA, 601 bp, Human
tgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataattacaacatttttaatttgttaagatttgttgtgtgggccacggtggtctatcttggagaatgttccatttctgctggagaaaagaygtattctgttgttatttgatagagagtgctctatttgtctgttaggttaattggtctatcatgttcaagtcatttgattcctatgatagtctccctggttgttctgtatatgaatgaatgcaggatattgaagtatcattttattattattattattatgttactgtccatttttccttcagttgtatctatgtttgtttcatatatctcattgctttagttttaggtgcagatctatttataattgttggctcttgctggtgaattgataattttatgccgctataatgtcctttgtct

SEQ ID NO: 77564 - DNA, 601 bp, Human
acatatcctcttctcttgctggtttaattgatggaagctttgaaattggtaacttttattttttctatttgataaccatacttgcataagttgaaaaacaaactgttcatgcatgctttatatcactgggtctggactaggtgtaaatttgtctctcatgggcaatttggcaatatgttaggatatttttgttgctataaatgggctggggcagggaggatgccactggtacctaggggtagaggtcaggtatgctgctaaacactgtgcaatgcaccagacagacttaccaacaaagaaktatccttcccaaaatgtctatagtgaggatgttgaaaaactctggtcctacacaaactcatggtttgcaaattaagtttttaggaaactttatctcccttgtctcaaggtgccccagtgtgaagaaaggttgagggaggactataattcttatggttttaggtggaaggactgcataggagcaacctacactagattctactgtttaactgtgtacaacattgggggtttaaagtcttttttttttttgaacattgaagatactgctttgatgtaatcattttaatttggatttctccaa

SEQ ID NO: 77565 - DNA, 601 bp, Human
catacttgcataagttgaaaaacaaactgttcatgcatgctttatatcactgggtctggactaggtgtaaatttgtctctcatgggcaatttggcaatatgttaggatatttttgttgctataaatgggctggggcagggaggatgccactggtacctaggggtagaggtcaggtatgctgctaaacactgtgcaatgcaccagacagacttaccaacaaagaagtatccttcccaaaatgtctatagtgaggatgttgaaaaactctggtcctacacaaactcatggtttgcaaattaastttttaggaaactttatctcccttgtctcaaggtgccccagtgtgaagaaaggttgagggaggactataattcttatggttttaggtggaaggactgcataggagcaacctacactagattctactgtttaactgtgtacaacattgggggtttaaagtcttttttttttttgaacattgaagatactgctttgatgtaatcattttaatttggatttctccaacaatagtgagattttatataataattgaaaatattatataataattgaaaataatatattttcaatataataattt

SEQ ID NO: 77566 - DNA, 601 bp, Human
gtaaatttgtctctcatgggcaatttggcaatatgttaggatatttttgttgctataaatgggctggggcagggaggatgccactggtacctaggggtagaggtcaggtatgctgctaaacactgtgcaatgcaccagacagacttaccaacaaagaagtatccttcccaaaatgtctatagtgaggatgttgaaaaactctggtcctacacaaactcatggtttgcaaattaagtttttaggaaactttatctcccttgtctcaaggtgccccagtgtgaagaaaggttgagggaggackataattcttatggttttaggtggaaggactgcataggagcaacctacactagattctactgtttaactgtgtacaacattgggggtttaaagtcttttttttttttgaacattgaagatactgctttgatgtaatcattttaatttggatttctccaacaatagtgagattttatataataattgaaaatattatataataattgaaaataatatattttcaatataataatttttcaaagaaaaattaaaatttttcttattttacaaactgctagcttatagcctctgctaattttcc

SEQ ID NO: 77567 - DNA, 601 bp, Human
ggtagaggtcaggtatgctgctaaacactgtgcaatgcaccagacagacttaccaacaaagaagtatccttcccaaaatgtctatagtgaggatgttgaaaaactctggtcctacacaaactcatggtttgcaaattaagtttttaggaaactttatctcccttgtctcaaggtgccccagtgtgaagaaaggttgagggaggactataattcttatggttttaggtggaaggactgcataggagcaacctacactagattctactgtttaactgtgtacaacattgggggtttaaagtcttttttttttttgaacattgaagatactgctttgatgtaatcattttaatttggatttctccaacaatagtgagattttatataataattgaaaatattatataataattgaaaataatatattttcaatataataatttttcaaagaaaaattaaaatttttcttattttacaaactgctagcttatagcctctgctaattttccctttttcttttcactttctaattatttggagggaccaccaaattgtctattatatagactgcaaatattttctacaattcatgtttctattctaa

SEQ ID NO: 77568 - DNA, 601 bp, Human
aacccatattaatccatcagaaaattcaacatcaagtttatcaacctgtttaattaatcaaaccttatcattcaatggaacatcacctgagatagtagaaaaaggtaagaattaatagtgacagtaaaacaaattctagattgatagatttaatcacgtctataaagtttctgatattctttaacaaaattgatttaagaacaaataggaagaacatttatcccttacatacagacaaaatcatactgttaatgtatgcagtcgattcttaaacaacacaggtttgaactgcacctgttcrcttatatgcagcttttgtccaaccaaacagaaggagaaacccaccaccgatgtggaggtctgacttctataggcggtttccacagggcaaatgagaggacttaagtctgtataaatttgtgtacatatgagttgtcctagaacaaacctcctagtgtacaaatggattattgtataccaagggcatttagaagtagataagaaaaaagaacaaatttagtaggaaatttgcaaagaacatacacatttaaaataaaaaagcagaaagtggtagaaatatgtgaataatataactttctct

SEQ ID NO: 77569 - DNA, 601 bp, Human
atggaacatcacctgagatagtagaaaaaggtaagaattaatagtgacagtaaaacaaattctagattgatagatttaatcacgtctataaagtttctgatattctttaacaaaattgatttaagaacaaataggaagaacatttatcccttacatacagacaaaatcatactgttaatgtatgcagtcgattcttaaacaacacaggtttgaactgcacctgttcgcttatatgcagcttttgtccaaccaaacagaaggagaaacccaccaccgatgtggaggtctgacttctataggyggtttccacagggcaaatgagaggacttaagtctgtataaatttgtgtacatatgagttgtcctagaacaaacctcctagtgtacaaatggattattgtataccaagggcatttagaagtagataagaaaaaagaacaaatttagtaggaaatttgcaaagaacatacacatttaaaataaaaaagcagaaagtggtagaaatatgtgaataatataactttctctttataaagatgcaaaatgttatagcatttgaagactttgtaactattataaacacaataatataagtataattt

SEQ ID NO: 77570 - DNA, 601 bp, Human
taaatttgtgtacatatgagttgtcctagaacaaacctcctagtgtacaaatggattattgtataccaagggcatttagaagtagataagaaaaaagaacaaatttagtaggaaatttgcaaagaacatacacatttaaaataaaaaagcagaaagtggtagaaatatgtgaataatataactttctctttataaagatgcaaaatgttatagcatttgaagactttgtaactattataaacacaataatataagtataattttaaccccaaaatttattaaaaataaatgaagtggaggaaaaaaaatgatttcaagttttctgtattgctgggagagtataaatttcaaagtctttctggagattaattttcaatacatattaaagaacaaaaatatacttgcctactttcttgattaatcttaaggaaatcatcagtaatgttcacaaggacatttcataatcacagccatgacatccatgtttaacagaataaaaaaaaatattttgtaacgacaaaagaagagattgtttaaccaaattaggaaactattattcaacacactactatgcagtaattaaaattttaatatagaagaa

SEQ ID NO: 77571 - DNA, 601 bp, Human
atgttatagcatttgaagactttgtaactattataaacacaataatataagtataattttaaccccaaaatttattaaaaataaatgaagtggaggaaaaaaaatgatttcaagttttctgtattgctgggagagtataaatttcaaagtctttctggagattaattttcaatacatattaaagaacaaaaatatacttgcctactttcttgattaatcttaaggaaatcatcagtaatgttcacaaggacatttcataatcacagccatgacatccatgtttaacagaataaaaaaaaatattttgtaacgacaaaagaagagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcgtctgtgtgtagtgtaattatagaaaatttttacttgttttctttgt

SEQ ID NO: 77572 - DNA, 601 bp, Human
aatatacttgcctactttcttgattaatcttaaggaaatcatcagtaatgttcacaaggacatttcataatcacagccatgacatccatgtttaacagaataaaaaaaaatattttgtaacgacaaaagaagagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataakgaatattatgcatattttgtgcactaaaaatgcagaagatctagaataacatttgcaatgatcgtctgtgtgtagtgtaattatagaaaatttttacttgttttctttgtgcccttccttattttcaaactttgtaaagtgaatatgaatcacttgtaattaggaaacaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgt

SEQ ID NO: 77573 - DNA, 601 bp, Human
tcataatcacagccatgacatccatgtttaacagaataaaaaaaaatattttgtaacgacaaaagaagagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcktctgtgtgtagtgtaattatagaaaatttttacttgttttctttgtgcccttccttattttcaaactttgtaaagtgaatatgaatcacttgtaattaggaaacaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgtggatctatgtcttcatggggaatatgcttcgtggcataggggaaacccccatagtaccattggg

SEQ ID NO: 77574 - DNA, 601 bp, Human
agagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcgtctgtgtgtagtgtaattatagaaaatttttacttgttttctttgtgcccttccttattttcaaamtttgtaaagtgaatatgaatcacttgtaattaggaaacaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtaacgtacagaa

SEQ ID NO: 77575 - DNA, 601 bp, Human
acactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcgtctgtgtgtagtgtaattatagaaaatttttacttgttttctttgtgcccttccttattttcaaactttgtaaagtgaatatgaatcacttgtaattaggaaasaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtaacgtacagaatatattaaatttcatgattacattccctggatctaccc

SEQ ID NO: 77576 - DNA, 601 bp, Human
cagtcaagtaaattttatttttcagttgatggtgacttggatgttgatgtgtagaactcagatgttgatgtttgctttgcgaaagcctccttgtggctgctgcattgacttacggcaggggtgggttaagagaggccacagtgcactttggttgtggtcatttttcctggttctcactgagggcttggcctatgggaacatttaatgagtgcttatagaacaaatgaatgaaggagaggatgcataaataaaatttacgacttttgtctttactctcagagcatgctttatttctcctctygtagaagaataagaatcaatgttgtaatatctgcctcgacttcaggccctccttcctacagatataccttcaccatatccatatttatctttttttaacccatacttatgaaaaagtatttatctttagctaatattagtagatccaactggggtttagatttcctctttctgcctctcctccatctgcaccctctcttttcctcagcaaacacactgaagtctctcccatctatgtacacatacacatttttatatccccaaacaactttccaattgattaactgtttctcaatttatc

SEQ ID NO: 77577 - DNA, 601 bp, Human
tgatgtgtagaactcagatgttgatgtttgctttgcgaaagcctccttgtggctgctgcattgacttacggcaggggtgggttaagagaggccacagtgcactttggttgtggtcatttttcctggttctcactgagggcttggcctatgggaacatttaatgagtgcttatagaacaaatgaatgaaggagaggatgcataaataaaatttacgacttttgtctttactctcagagcatgctttatttctcctcttgtagaagaataagaatcaatgttgtaatatctgcctcgacttcaggccctccttcctacagatataccttcaccatatccatatttatctttttttaacccatacttatgaaaaagtatttatctttagctaatattagtagatccaactggggtttagatttcctctttctgcctctcctccatctgcaccctctcttttcctcagcaaacacactgaagtctctcccatctatgtacacatacacatttttatatccccaaacaactttccaattgattaactgtttctcaatttatcttcaaagccaagtacctagaaaaacatcatctaacataagtatc

SEQ ID NO: 77578 - DNA, 601 bp, Human
gtgtagctacacgttatgtacatcatttttactcatttgctctactttaatcattgcttttaacactgagtacaaagtaagtgttgaaggtctttaggatagtagttttgtagcctctctattcagaaataagcacaccattttagaattcatggtgattcaacttctacccctgactgttcagaccttatcacatcttctcttattctgtgagaagcatgaagtgaacttatgataaagtatactttggtaaattttaattcctacaggatccaaagacataacataaatgagtaaagartatcaagggcaggaaattagggtatgatggttagaatggggagagttgttgttggtgcactactctccccatacacactaaaactcatgtgctccccagctctggtctatacttttcatacagaattttggcaccggcattaataaggctttctgattggttttccagagaatccaggaaccaagattttaatgtagaattttccaatttttaagattgtgtgtgagccacgggaagcactagcaggacatatctagcttggttatgacctttagttcctatatatagaccagtgaaaga

SEQ ID NO: 77579 - DNA, 601 bp, Human
agtgttgaaggtctttaggatagtagttttgtagcctctctattcagaaataagcacaccattttagaattcatggtgattcaacttctacccctgactgttcagaccttatcacatcttctcttattctgtgagaagcatgaagtgaacttatgataaagtatactttggtaaattttaattcctacaggatccaaagacataacataaatgagtaaagaatatcaagggcaggaaattagggtatgatggttagaatggggagagttgttgttggtgcactactctccccatacacacyaaaactcatgtgctccccagctctggtctatacttttcatacagaattttggcaccggcattaataaggctttctgattggttttccagagaatccaggaaccaagattttaatgtagaattttccaatttttaagattgtgtgtgagccacgggaagcactagcaggacatatctagcttggttatgacctttagttcctatatatagaccagtgaaagaaccaaaaacagtcatcaaaattacatttctgacaagtgataagtaaacacttagcatgtataatggagttactgattta

SEQ ID NO: 77580 - DNA, 601 bp, Human
aatggggagagttgttgttggtgcactactctccccatacacactaaaactcatgtgctccccagctctggtctatacttttcatacagaattttggcaccggcattaataaggctttctgattggttttccagagaatccaggaaccaagattttaatgtagaattttccaatttttaagattgtgtgtgagccacgggaagcactagcaggacatatctagcttggttatgacctttagttcctatatatagaccagtgaaagaaccaaaaacagtcatcaaaattacatttctgacargtgataagtaaacacttagcatgtataatggagttactgatttaactagtcatttcctgaagtctgcctgagttgttgattatgaaacaatatgatcacataaatcaattttaaaaccagatcagtccatactagcaaataatatatttctaaatagttttaaatcaattcaatattttttcatgtcaatgatttttcttatagatcagagtaatggcatcagttaagtttgctacaaacttctatggtgtgtgtgtttccgtgtgtgtatgctttcttaatctttattatttttatttt

SEQ ID NO: 77581 - DNA, 601 bp, Human
actgatttaactagtcatttcctgaagtctgcctgagttgttgattatgaaacaatatgatcacataaatcaattttaaaaccagatcagtccatactagcaaataatatatttctaaatagttttaaatcaattcaatattttttcatgtcaatgatttttcttatagatcagagtaatggcatcagttaagtttgctacaaacttctatggtgtgtgtgtttccgtgtgtgtatgctttcttaatctttattatttttattttactgagataagaacaattaaaatggactctacctcycaaaaatacaattgaaccttgaacagcacagatttgaactgtgcaggtccacttatacatagtttttttgataaatgtattggaaacatttttcgagatttgtgacgacatgaaaaaccttgcagataaactaggcagcttacaaatacagaaaaagttaagagaaaattagttatattgtgaatacataaaatatatgtaaatattattttataatttactacaataaaatatgcacaaatctattattaaaagttaaaatttgttaaactttacacagagaaactcttatagacctta

SEQ ID NO: 77582 - DNA, 601 bp, Human
tgaactgtgcaggtccacttatacatagtttttttgataaatgtattggaaacatttttcgagatttgtgacgacatgaaaaaccttgcagataaactaggcagcttacaaatacagaaaaagttaagagaaaattagttatattgtgaatacataaaatatatgtaaatattattttataatttactacaataaaatatgcacaaatctattattaaaagttaaaatttgttaaactttacacagagaaactcttatagaccttacatgatgccattcccagtcacagtattaaatcatractgcataaaattaactgtagtgcctacttcactgctgtaaaaattctgtaatcatctcctgttgttattgcagtaagctcaagtgttgagagtatttatttaaaatgccatgtgtcattcatcatctccatatgagtagttttcatcactctccagtaagtgatgaatcacagtaaaaagtgaacccttgtgttttctgcgtatttttcatcctgttaagtgctgtaacatcaaccttaagtaacactgtgtgagccgtatgaagtaccactagtgatgctggaagtgctcccagaagc

SEQ ID NO: 77583 - DNA, 601 bp, Human
atttttcgagatttgtgacgacatgaaaaaccttgcagataaactaggcagcttacaaatacagaaaaagttaagagaaaattagttatattgtgaatacataaaatatatgtaaatattattttataatttactacaataaaatatgcacaaatctattattaaaagttaaaatttgttaaactttacacagagaaactcttatagaccttacatgatgccattcccagtcacagtattaaatcatgactgcataaaattaactgtagtgcctacttcactgctgtaaaaattctgtaaycatctcctgttgttattgcagtaagctcaagtgttgagagtatttatttaaaatgccatgtgtcattcatcatctccatatgagtagttttcatcactctccagtaagtgatgaatcacagtaaaaagtgaacccttgtgttttctgcgtatttttcatcctgttaagtgctgtaacatcaaccttaagtaacactgtgtgagccgtatgaagtaccactagtgatgctggaagtgctcccagaagcaaagaaaagtcatgacattataagaaaaagttgaattgtttaatatgtactgt

SEQ ID NO: 77584 - DNA, 601 bp, Human
tatgaaaacttaaagcaaaaggaaagtgaatgatttaaagctggagaacttcatgccactaatgcataatttgaaaattttctaaagaggtttgcctcaaaaaagtgtcagtataacaggagaagcagctcctgccacttaggagtaacagaaaagttctaaatggcataaagaaagtcattgaggagaaaggacatctacctgagcaggtttttaatccgatgaaagtgccctattctggaaaaaaaataccacaaagtacacttattaatgaggaagataagtgagtaccagtatttawggcaggaagggataggctaacgctgatgttctgtgcaaatgcagtggggtttatgatcggaactgttcttacctatacaactgctaatccctaagccttgaaggggaaatagtaaaaaacagttgttagtcttttggttgtatgacaagaaggcctgaacaataactttttttctgaaaagttatgacagtttccttccatgctttgttcctgaagacaggaagtaccttggcaggaagggtttaccttttaaagtccttttgataattggcaatgctcttggtcatccagaacctcatg

SEQ ID NO: 77585 - DNA, 601 bp, Human
aaagtgaatgatttaaagctggagaacttcatgccactaatgcataatttgaaaattttctaaagaggtttgcctcaaaaaagtgtcagtataacaggagaagcagctcctgccacttaggagtaacagaaaagttctaaatggcataaagaaagtcattgaggagaaaggacatctacctgagcaggtttttaatccgatgaaagtgccctattctggaaaaaaaataccacaaagtacacttattaatgaggaagataagtgagtaccagtatttaaggcaggaagggataggctaacrctgatgttctgtgcaaatgcagtggggtttatgatcggaactgttcttacctatacaactgctaatccctaagccttgaaggggaaatagtaaaaaacagttgttagtcttttggttgtatgacaagaaggcctgaacaataactttttttctgaaaagttatgacagtttccttccatgctttgttcctgaagacaggaagtaccttggcaggaagggtttaccttttaaagtccttttgataattggcaatgctcttggtcatccagaacctcatgagttgaatactgaaggtgctga

SEQ ID NO: 77586 - DNA, 601 bp, Human
ataacaggagaagcagctcctgccacttaggagtaacagaaaagttctaaatggcataaagaaagtcattgaggagaaaggacatctacctgagcaggtttttaatccgatgaaagtgccctattctggaaaaaaaataccacaaagtacacttattaatgaggaagataagtgagtaccagtatttaaggcaggaagggataggctaacgctgatgttctgtgcaaatgcagtggggtttatgatcggaactgttcttacctatacaactgctaatccctaagccttgaaggggaaatartaaaaaacagttgttagtcttttggttgtatgacaagaaggcctgaacaataactttttttctgaaaagttatgacagtttccttccatgctttgttcctgaagacaggaagtaccttggcaggaagggtttaccttttaaagtccttttgataattggcaatgctcttggtcatccagaacctcatgagttgaatactgaaggtgctgaagtggtctgctttaccccaaactcaatgtctctaattcaccctctagatgtggggtcctaaggacatttaaggctcattatacatgttac

SEQ ID NO: 77587 - DNA, 601 bp, Human
aagacatggatcttggagacattcaagaggtaacaggcacaacagaggaattaacagaagacaacttgatggagataagtgcttctgaactaatgtcagatgatgaggaagaagacatggaagaagcagcgacagaaacaaattgacatcagacagtctggcagaagtgttctgattattcaagactgttttgatgtattttacaacatggaagcttctgtaatgtgggcactgaaatgaaagcaaacagtggaagaaggattggtatcatatagaaacattttcagagaaatgataaagyaacaaagtcaaatagaaattatgatgtatttctgtaaagccacactgtgtgtacctgtctttcctgtagaaattatgatgtgtttctgtaaagccacactgtgtgtacctgcctttcctgtctttctttttacctcctccactgcctctgcctctactaccctagagaaagcaagaacagtgcctccccttcctcctcctctacctattcaatgtgaagagatgaggatgatgaaaagcgttatgatgacccacttccacttaatgaatagtaaacacatttccttgtgattttctaaat

SEQ ID NO: 77588 - DNA, 601 bp, Human
cattttagaaattaacaccttatcacatatatgctttatgaatattttctcttattccgtatgttgccttttcactctgttgattatttcttttgctgggtagaagctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatataygataaggatataacatcattttcttgtatgtgaatatctggttttctcaacaccatttatcagagaaacaattatttcactatcgtggtcccttgtcaaagatcagatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcata

SEQ ID NO: 77589 - DNA, 601 bp, Human
gaatattttctcttattccgtatgttgccttttcactctgttgattatttcttttgctgggtagaagctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatcyggttttctcaacaccatttatcagagaaacaattatttcactatcgtggtcccttgtcaaagatcagatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttc

SEQ ID NO: 77590 - DNA, 601 bp, Human
tcactctgttgattatttcttttgctgggtagaagctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatctggttttctcaacaccatttatcagagaaacarttatttcactatcgtggtcccttgtcaaagatcagatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttccttctattcccagatttttgagggcttttatt

SEQ ID NO: 77591 - DNA, 601 bp, Human
ctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatctggttttctcaacaccatttatcagagaaacaattatttcactatcgtggtcccttgtcaaagatcasatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttccttctattcccagatttttgagggcttttattatgaagggatgttgaattttatcaagtgctttttt

SEQ ID NO: 77592 - DNA, 601 bp, Human
ctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatctggttttctcaacaccatttatcagagaaacaattatttcactatcgtggtcccttgtcaaagatcagatgactgtatacacacagatttctctgggctctgtattccattctrttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttccttctattcccagatttttgagggcttttattatgaagggatgttgaattttatcaagtgcttttttagcatcaattgaaatgatcatatgatttttacctttcattctgttt

SEQ ID NO: 77593 - DNA, 601 bp, Human
tattccctgctcctccattttttggaatggtttgaatagtattggcattaattatttcagtctctttgttaaattatctgatagtttctgaattccttctctgtgttatcttgaatttctctgagtttcttcagaatagctatgttgaattctctgtttgaaagattacatatgtctgtttcaccaggattgttccctggtgccttatttaatttgtttggtgaggtcatgttttcctggctcatcttagtgcttatgttattcatcagtgtctgggcattgatgacttaggtatttattstagtctttgttgtctgggtttgtttttgcctatccttctttactaggctttttaggtatatgaagggactttggccacaacctcaataatactgtggtttttacagtcttagagaggtactgccttggtggccttggaaagtatatggaagaattctctggattattaggcagagactcttgttctcttcccctgctttctccaaagcaaatgtagtcttgctctttctgtgctgagctgccagaaactgggggttcactgatgcaagcaagcatccttgtggccccccaaccactgaga

SEQ ID NO: 77594 - DNA, 601 bp, Human
atgcaagcaagcatccttgtggccccccaaccactgagactgtcctgggtaagacctgaagccagcacagcactgggtcttgcccaaggccctctttaactactgtcgggctaccatctatgttaactcaagatcaagggctctacaatcagtagttggccaagccagccaggtttgtatccttcccttcaatgcagtgagttcctctaggcctcaggctggcctacagatgctgtctgagagccaaggattggagcaaaaaacccttgcaatttacctgtaatagatatctgttttactrtggctacgctggcacccaaaccacagcacaaagttcttcttgctcttctctccccttgccacaggcagaggagcctctccctgtgtccaccaccaccacaggcccaaggaagattctgccaggccaccacccatgttcaattaaagctctagggctcttcagtcagtttattatgaatgctgccaggtctcagagactcatccttcagggcagtgggtctcttagtccaggactaggctattggacagcatttctagacttgcctctggcccagggcaggtctagaaatgctttccaaga

SEQ ID NO: 77595 - DNA, 601 bp, Human
cctgaagccagcacagcactgggtcttgcccaaggccctctttaactactgtcgggctaccatctatgttaactcaagatcaagggctctacaatcagtagttggccaagccagccaggtttgtatccttcccttcaatgcagtgagttcctctaggcctcaggctggcctacagatgctgtctgagagccaaggattggagcaaaaaacccttgcaatttacctgtaatagatatctgttttactatggctacgctggcacccaaaccacagcacaaagttcttcttgctcttctctccmcttgccacaggcagaggagcctctccctgtgtccaccaccaccacaggcccaaggaagattctgccaggccaccacccatgttcaattaaagctctagggctcttcagtcagtttattatgaatgctgccaggtctcagagactcatccttcagggcagtgggtctcttagtccaggactaggctattggacagcatttctagacttgcctctggcccagggcaggtctagaaatgctttccaagagcttagtcctggactcagggaccccaaaagccttcttgttgctctgttctactg

SEQ ID NO: 77596 - DNA, 601 bp, Human
caattaaagctctagggctcttcagtcagtttattatgaatgctgccaggtctcagagactcatccttcagggcagtgggtctcttagtccaggactaggctattggacagcatttctagacttgcctctggcccagggcaggtctagaaatgctttccaagagcttagtcctggactcagggaccccaaaagccttcttgttgctctgttctactgtagctgagctgctacctaaggtgcaagacaaagtcgcctttatttttccaccacttctcttaaacagaaggagtctttcaccgyaaccaccatggctgggattgtgcttggtcacacctgaagtcagcaaatctcagagcccaaggccctgagtgcattactttgcattactttggtaccactgctggttatttagggcctgagggctctttagtcaactgatgataaatgctgccaggagtgggtccttcccttcaaggcagtggattcctttttggcccaggatgtgcctagaaatgttgtccatgagttagggcctcaaaactctgcctggtgccctattttactgtggctgagctggtattagaaaaaatattttgcaat

SEQ ID NO: 77597 - DNA, 601 bp, Human
ggctctttagtcaactgatgataaatgctgccaggagtgggtccttcccttcaaggcagtggattcctttttggcccaggatgtgcctagaaatgttgtccatgagttagggcctcaaaactctgcctggtgccctattttactgtggctgagctggtattagaaaaaatattttgcaatctatgccttagaaaaaaagaatcacctctccaactcttcatggactggccttattgtaggagaaaaccttcatcaatcagcccagccatatcttcttgggcctctcaaattttcatggtcrtccaaacatctatctttgtcttaggatcccccaggcatctagagtatgcagggtcttatcagcacctttacacatttgagacagaagacagtccttagtcaactcttaggaaagtttgaatatttggcatgctgtccaactctttcccttcccatggagaatttggaagctgagatttcttacctcatcactctgcttaaatctaggggcaggaagaacttggcaagtgcccatgtgctagtttaaatcatcatttttgtgttctttgtagcacccaggggccaagtgtatgcctaacct

SEQ ID NO: 77598 - DNA, 601 bp, Human
atcatttttgtgttctttgtagcacccaggggccaagtgtatgcctaacctaaagacaaggaagacaaaatacctttccttgatagaactcagaaaagatgaaatgttatatatgtggtccaaatctttgtttccccatggaggagctaagagctgagatgttgttgttgtttttgtttttgtttgtttttgcctgctcactctgcactaacctagggggcaggatctgtgataaatatccacatactggctcatctttattctctgtagttcccaggtgtctggcatatgctgggtcctstcagtacttcgagacagatgagatagaagctaatctattgggtagcacttggaaaggttgaaatgttgaatgtgcagtccagccctttctctccccaaggataagctgggagcattttttaaaaattttattttactttaagttccaggatacatgtgcagaatgtacaggtttgttacataggtaaacatgtgcaatggtggtttgctgcacctatcaacccatcacctaggtattaagtcccacatgcattagctatttgtcctgatgctctccctccttctgcccccatgacaggcc

SEQ ID NO: 77599 - DNA, 601 bp, Human
agggggcaggatctgtgataaatatccacatactggctcatctttattctctgtagttcccaggtgtctggcatatgctgggtcctctcagtacttcgagacagatgagatagaagctaatctattgggtagcacttggaaaggttgaaatgttgaatgtgcagtccagccctttctctccccaaggataagctgggagcattttttaaaaattttattttactttaagttccaggatacatgtgcagaatgtacaggtttgttacataggtaaacatgtgcaatggtggtttgctgcacytatcaacccatcacctaggtattaagtcccacatgcattagctatttgtcctgatgctctccctccttctgcccccatgacaggccccagtgtgtattgttcccctctttgtgtttatgtcttctcagtgttcagctccttcttgtgagaacatgcagtgtttgattttctgtttctgtgttagtttgctgaagataatggctttcagcttcatacatgtccctgcaaaggacattatctccttcctttttatggctgcatagtattccatggtgtatatgtaccacatttgccttatac

SEQ ID NO: 77600 - DNA, 601 bp, Human
tattgttcccctctttgtgtttatgtcttctcagtgttcagctccttcttgtgagaacatgcagtgtttgattttctgtttctgtgttagtttgctgaagataatggctttcagcttcatacatgtccctgcaaaggacattatctccttcctttttatggctgcatagtattccatggtgtatatgtaccacatttgccttatacagtctatcattgatgggtatttgggttggttccatgattttgctattgtaaataatgctgcaataaacatacatgtgcatgtatctttataatakaatgatttatattcctttgggtatatacccagtaaagggattgctggatcaaatggcatttctggttctagatccttgaggaattgccacattttttgtttttttctttttctctcacacattcgctctgtgttaagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatc

SEQ ID NO: 77601 - DNA, 601 bp, Human
atgatttatattcctttgggtatatacccagtaaagggattgctggatcaaatggcatttctggttctagatccttgaggaattgccacattttttgtttttttctttttctctcacacattcgctctgtgttaagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatctytcagttagcttctgtatttctcacaaatgaaattgatctgaatattactgttgaatcagtatgttcatggagaaaaaggtatctgtccttcttattctggtatcttgctgatatctcatggatgcattcctgttacttaaactgtatattttctacctactaaaataactcattgacatttgagatatagcatttacacattactcttatacatactttaagggaaatatagttgaaataaaatggttaaatgatttctaacatttagagtccaatatttctgggttactcttaaactca

SEQ ID NO: 77602 - DNA, 601 bp, Human
atatacccagtaaagggattgctggatcaaatggcatttctggttctagatccttgaggaattgccacattttttgtttttttctttttctctcacacattcgctctgtgttaagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatctctcagttagcttctgtatttcycacaaatgaaattgatctgaatattactgttgaatcagtatgttcatggagaaaaaggtatctgtccttcttattctggtatcttgctgatatctcatggatgcattcctgttacttaaactgtatattttctacctactaaaataactcattgacatttgagatatagcatttacacattactcttatacatactttaagggaaatatagttgaaataaaatggttaaatgatttctaacatttagagtccaatatttctgggttactcttaaactcagattttcattttgcatagttt

SEQ ID NO: 77603 - DNA, 601 bp, Human
taagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatctctcagttagcttctgtatttctcacaaatgaaattgatctgaatattactgttgaatcagtatgttcatggagaaaaaggtatctgtccttcttattctggtatcttgctgatatctcatggatgcattcctrttacttaaactgtatattttctacctactaaaataactcattgacatttgagatatagcatttacacattactcttatacatactttaagggaaatatagttgaaataaaatggttaaatgatttctaacatttagagtccaatatttctgggttactcttaaactcagattttcattttgcatagtttttcatcctctgtgctgtctggagagttgcaaatgcaggttcctgggtagttagggtgctgtggatggaagctcctttattgtctctaagtattttttgccagctgcttaaa

SEQ ID NO: 77604 - DNA, 601 bp, Human
taaaaaaaaataaagcatactcaaatcatctagagtcagctttcttctctgctaaatttagctgaattattttttctaaaactcctattaaaattaacaaatatgtcttgagtacataaaaaggggaagaggattaggtttctgctctttagaagagagaaaccaatcaaaggctacaaacatctgttgcttataagccagagtatatattcattttaatataatatagtataaactgtgagggtttaaaggattataatttttcattcatttatttatttaacaaatgataccagccatsatactattctctggtaatagaacattgcctttattttttgagaacctggtggatgatattaagacgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaag

SEQ ID NO: 77605 - DNA, 601 bp, Human
ctgctaaatttagctgaattattttttctaaaactcctattaaaattaacaaatatgtcttgagtacataaaaaggggaagaggattaggtttctgctctttagaagagagaaaccaatcaaaggctacaaacatctgttgcttataagccagagtatatattcattttaatataatatagtataaactgtgagggtttaaaggattataatttttcattcatttatttatttaacaaatgataccagccatcatactattctctggtaatagaacattgcctttattttttgagaacctrgtggatgatattaagacgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtaaataatgtgaat

SEQ ID NO: 77606 - DNA, 601 bp, Human
attattttttctaaaactcctattaaaattaacaaatatgtcttgagtacataaaaaggggaagaggattaggtttctgctctttagaagagagaaaccaatcaaaggctacaaacatctgttgcttataagccagagtatatattcattttaatataatatagtataaactgtgagggtttaaaggattataatttttcattcatttatttatttaacaaatgataccagccatcatactattctctggtaatagaacattgcctttattttttgagaacctggtggatgatattaagamgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtaaataatgtgaattaggattccttaccact

SEQ ID NO: 77607 - DNA, 601 bp, Human
ttttgagaacctggtggatgatattaagacgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtmaataatgtgaattaggattccttaccacttgatagtggtgcctctgtccaatataagccaaatgggctaatggagtaccattgagaagcaataatcaagagaatgatctggcagctgtcagagcaagatatatcaaatggtaaggtattgacagcagttttcagattagggagaaatggtgaagtagtaaaacctgaagcagtgcaaccaacacttaaacccttggcactttttaaagttttcattgaagtaaacttacaaactttccaaagtaacccatgttctttctctcatcagttc

SEQ ID NO: 77608 - DNA, 601 bp, Human
gtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtaaataatgtgaattaggattccttaccacttgatagtggtgcctctgtccaatataagccawatgggctaatggagtaccattgagaagcaataatcaagagaatgatctggcagctgtcagagcaagatatatcaaatggtaaggtattgacagcagttttcagattagggagaaatggtgaagtagtaaaacctgaagcagtgcaaccaacacttaaacccttggcactttttaaagttttcattgaagtaaacttacaaactttccaaagtaacccatgttctttctctcatcagttccttcacttacctttttttttgttgttgttattttctcctctccaccacactaacccaagag

SEQ ID NO: 77609 - DNA, 601 bp, Human
agcaacatcagtaattaagatatttggagtaaataatgtgaattaggattccttaccacttgatagtggtgcctctgtccaatataagccaaatgggctaatggagtaccattgagaagcaataatcaagagaatgatctggcagctgtcagagcaagatatatcaaatggtaaggtattgacagcagttttcagattagggagaaatggtgaagtagtaaaacctgaagcagtgcaaccaacacttaaacccttggcactttttaaagttttcattgaagtaaacttacaaactttccamagtaacccatgttctttctctcatcagttccttcacttacctttttttttgttgttgttattttctcctctccaccacactaacccaagagcaatgggatggatgctggagccttgtgtattcactcatgagagtggattgctcaatttcagctgcgttggtagcttgaaattgtccatggtaggagaatttaccgtcatgtattaccatggaaattgaaaaatatcacaaatcgagtttgtttcccagtgaatctgttgttaaacatttaccagcacatcattgataagtttttgtagt

SEQ ID NO: 77610 - DNA, 601 bp, Human
tttcccagtgaatctgttgttaaacatttaccagcacatcattgataagtttttgtagtttaacatgcatactaaaaacagcgtatcaaggattttttattttgtctatgctatgtttctactttaatcaaatccataacaattgatgaatttttttttttgagacagagtctcgctctgtcacccaggctggagtgcagtggtgcaatcttgactcactgcaacctccacctcccaggttcaagcaattctcctgcctcagcctcccgagtagctgggactacaggcacacactgccatrcccggctaattttttgtatttttgtagagacggggtttcaccgtgttggccaggctggtctggaactcctgagctgagacaatccacctgccttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgatgtgaatagtaaagcgaattt

SEQ ID NO: 77611 - DNA, 601 bp, Human
ttttttattttgtctatgctatgtttctactttaatcaaatccataacaattgatgaatttttttttttgagacagagtctcgctctgtcacccaggctggagtgcagtggtgcaatcttgactcactgcaacctccacctcccaggttcaagcaattctcctgcctcagcctcccgagtagctgggactacaggcacacactgccatacccggctaattttttgtatttttgtagagacggggtttcaccgtgttggccaggctggtctggaactcctgagctgagacaatccacctgcyttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaacta

SEQ ID NO: 77612 - DNA, 601 bp, Human
cctcccgagtagctgggactacaggcacacactgccatacccggctaattttttgtatttttgtagagacggggtttcaccgtgttggccaggctggtctggaactcctgagctgagacaatccacctgccttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgt

SEQ ID NO: 77613 - DNA, 601 bp, Human
ctacaggcacacactgccatacccggctaattttttgtatttttgtagagacggggtttcaccgtgttggccaggctggtctggaactcctgagctgagacaatccacctgccttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgaygtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgtatagaagttcagtttaga

SEQ ID NO: 77614 - DNA, 601 bp, Human
cccaaaaagaataaagaagataataaggtgcaaaaaaaggggcaactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcargtagcataatgtcacttgaattgtttattgatccattttttaatggatcaacattgtagtgagttatgattgtatagaagttcagtttagatgacatctgagttcctatttacctcaaaaatttaacaatttggttaattcacatgttccatttattttgagcaaaggtcgcgactctcttagaaagcctcacaaatcatttgtaactttaagtcttatataacttatatttacaaaattcagatattaatatatattttattattgaaatatgttatttttataactctataggttttt

SEQ ID NO: 77615 - DNA, 601 bp, Human
aactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttartggatcaacattgtagtgagttatgattgtatagaagttcagtttagatgacatctgagttcctatttacctcaaaaatttaacaatttggttaattcacatgttccatttattttgagcaaaggtcgcgactctcttagaaagcctcacaaatcatttgtaactttaagtcttatataacttatatttacaaaattcagatattaatatatattttattattgaaatatgttatttttataactctataggttttttccagtctttgaaaagcatccttaccaatcccctgtatgttat

SEQ ID NO: 77616 - DNA, 601 bp, Human
tagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgtatagaagttcagtttagatgacatctgagttcctatttacctcaaaaatttaacaatttggttaattcacatgttccatttattttgagcaaaggtcrcgactctcttagaaagcctcacaaatcatttgtaactttaagtcttatataacttatatttacaaaattcagatattaatatatattttattattgaaatatgttatttttataactctataggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggtaagacatatt

SEQ ID NO: 77617 - DNA, 601 bp, Human
ttccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgtatagaagttcagtttagatgacatctgagttcctatttacctcaaaaatttaacaatttggttaattcacatgttccatttattttgagcaaaggtcgcgactctyttagaaagcctcacaaatcatttgtaactttaagtcttatataacttatatttacaaaattcagatattaatatatattttattattgaaatatgttatttttataactctataggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggtaagacatattttttacct

SEQ ID NO: 77618 - DNA, 601 bp, Human
gcctattttcaaagtcatattgagaccttctcattaaggaaaggttatcttatatcccttttcccacaactccagtattgtagaaaccttgtagaaatttgataagtatttgatgagttaaacagtgtatcaaatggtatgtatctaggtcatatgtacataggaaagtaataattagaaaatgaatgtactgaagcattggaacaggcttctggatgatctccctgttgaactgacagatttaaacttaaaagattcagttttgactcccaataacctggcttgaattttttgttagagkaatcttcacctttaataacacttacgggactgtgaaatggaaaaaatgtaacagggatcagtcatttttaatcctgtatgtagacatttttatcatatcatggtagatatgtcttttatgaataataaagagatattaattcaagaatttaattctaaagcctgggcaaaattggagtgagttattgaggattgaaacattttgagaaatgtataaaggattttttagatggtaggatagaaatctcagagaaagaaagattttgtttttgttgttgattgccagaaaaaaagaaagctc

SEQ ID NO: 77619 - DNA, 601 bp, Human
cttgtagaaatttgataagtatttgatgagttaaacagtgtatcaaatggtatgtatctaggtcatatgtacataggaaagtaataattagaaaatgaatgtactgaagcattggaacaggcttctggatgatctccctgttgaactgacagatttaaacttaaaagattcagttttgactcccaataacctggcttgaattttttgttagaggaatcttcacctttaataacacttacgggactgtgaaatggaaaaaatgtaacagggatcagtcatttttaatcctgtatgtagacakttttatcatatcatggtagatatgtcttttatgaataataaagagatattaattcaagaatttaattctaaagcctgggcaaaattggagtgagttattgaggattgaaacattttgagaaatgtataaaggattttttagatggtaggatagaaatctcagagaaagaaagattttgtttttgttgttgattgccagaaaaaaagaaagctcctcatagaaataacctttttagacacgtaaatattcttagccactgcctttttcttgtgaggaagccaagccctcataattggccaa

SEQ ID NO: 77620 - DNA, 601 bp, Human
ccaacatatccattggaaattccatttctttcttaactcaaaggcttttttttttccatgtgacacatatcctgtttttcccaatatcctgggtaactcccaatgattggaaattaggtatgctgttccccatacctacaatcaattcaacatctcacaagttgcataactatttttcaggccctttccctattaccaacattagcaatatagtcagctgcgattatgactctctaccacactcttccatgcttcaattctaaacattttctatctttcccttgcccaatatcctaccaaygtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgctatgtgggggctactgca

SEQ ID NO: 77621 - DNA, 601 bp, Human
tattaccaacattagcaatatagtcagctgcgattatgactctctaccacactcttccatgcttcaattctaaacattttctatctttcccttgcccaatatcctaccaacgtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccwgtagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgtttt

SEQ ID NO: 77622 - DNA, 601 bp, Human
ttaccaacattagcaatatagtcagctgcgattatgactctctaccacactcttccatgcttcaattctaaacattttctatctttcccttgcccaatatcctaccaacgtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccagyagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttga

SEQ ID NO: 77623 - DNA, 601 bp, Human
gcccaatatcctaccaacgtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgcyatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttgagatggagtctcaccctgtcacccaggctggagtgcaatggcatggtctcggctcactgcagcctccacctcctgggttcaagcaattctcc

SEQ ID NO: 77624 - DNA, 601 bp, Human
tacttaaaagcccacatctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatrttattcctattgaaaaaaaataaaaggaaaaaaggaatctttcttgaaccatacgagtatggatttaaattcttttttttgttttgagatggagtctcaccctgtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgac

SEQ ID NO: 77625 - DNA, 601 bp, Human
tctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaamaaaataaaaggaaaaaaggaatctttcttgaaccatacgagtatggatttaaattcttttttttgttttgagatggagtctcaccctgtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgc

SEQ ID NO: 77626 - DNA, 601 bp, Human
gaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttgagatggagtctcrccctgtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgcctcatcctcccaaagtgctgggattacaggtgtgagtgaccacgcctggccaattcttttacaagttctccttcagtaaatag

SEQ ID NO: 77627 - DNA, 601 bp, Human
acatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttgagatggagtctcaccctgtcacccaggctggagtgcaatggcatggtctcggctcactgcarcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgcctcatcctcccaaagtgctgggattacaggtgtgagtgaccacgcctggccaattcttttacaagttctccttcagtaaatagtcttcagcagtagtaggttcaagatgaacttaaatctttagcctagaat

SEQ ID NO: 77628 - DNA, 601 bp, Human
gtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgcctcatcctcccaaagtgctgggattacaggtgtgagtgaccacgcctggccaattcttttacaagttctccttcagtaaatagtcttyagcagtagtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcacctctgcctggctctgtttcctctgcactctgtcccattttcatgag

SEQ ID NO: 77629 - DNA, 601 bp, Human
ttttacaagttctccttcagtaaatagtcttcagcagtagtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcacctctgcctggctctrtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacaccaatttcttaaattcctaaattcagggagctattttgccttcactattaagcaactatatttttataacatttttt

SEQ ID NO: 77630 - DNA, 601 bp, Human
tagtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcacctctgcctggctctgtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacgtctttaaata

SEQ ID NO: 77631 - DNA, 601 bp, Human
gtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcacctctgcctggctctgtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacgtctttaaatata

SEQ ID NO: 77632 - DNA, 601 bp, Human
tatattctaaccattagccagcacattcttttgtgttaaacctttctggtaataatatactatatcttgtcacctgtcattatggtcttgaatgttgcttttgcctgcttaaatagaattctggcacctctgcctggctctgtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtrggtggaagagaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacgtctttaaatataatggaatgtattcatagccctgttgtatttggcaaatgtatttgttaatatttcaaaaactatttttaggtgttttataactgtagttgtgtggaagtaactggtctccagaacagaaat

SEQ ID NO: 77633 - DNA, 601 bp, Human
ttgtcacctgtcattatggtcttgaatgttgcttttgcctgcttaaatagaattctggcacctctgcctggctctgtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacacyaatttcttaaattcctaaattcagggagctattttgccttcactattaagcaactatatttttataacattttttaaactgtaaatattttagtttgagacgtctttaaatataatggaatgtattcatagccctgttgtatttggcaaatgtatttgttaatatttcaaaaactatttttaggtgttttataactgtagttgtgtggaagtaactggtctccagaacagaaattactcagcacacttgggtgaatgcccaagagataatacttgtacaaggaaatttttcatctatgtt

SEQ ID NO: 77634 - DNA, 601 bp, Human
atgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacktctttaaatataatggaatgtattcatagccctgttgtatttggcaaatgtatttgttaatatttcaaaaactatttttaggtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagtaagtatgatcctgtaaaacattgtcatgtata

SEQ ID NO: 77635 - DNA, 601 bp, Human
agaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacgtctttaaatataatggaatgtattcatagccctgttgtatttggcaaatgtatttgttaatatttcaaaaactatttttaggtgttttataactgtagttgtgtggaagtaactggtctccagaacagaaattactcagcrcacttgggtgaatgcccaagagataatacttgtacaaggaaatttttcatctatgttgcaattcaagtcataaactctttgttctctgcaacaggaggtaccacatttatcttgttgactgtgaagtaagtatgatcctgtaaaacattgtcatgtatattagactaaaacacacctaatgataggcatatttttctgtattttgagctcaaattcatattttgtcaatttttaattctttgagaatgcattttcttagaattattttgatatttcaataacatcattaataatttttgt

SEQ ID NO: 77636 - DNA, 601 bp, Human
ctttgagaatgcattttcttagaattattttgatatttcaataacatcattaataatttttgtctctaatacttccattgtcaaatctaggctctatactttcttctctttaataaaaatcttaaggcacacactgattgacagttgccttgattgtaggagaatctttgtgtgattgtaaaagaacttttaattttgagttgcgttgcatcctaatgagccagttaagagtaaatcatctgttgatttcattgaaagaaaacatttagcaaccaggtataaatacaaacttcaatttgtwatgaaattctaatgctttcaattcacccacagcatggcttttgacctggtatttcatgatacccttgtagggcataagaaaaatatgtgtaaataattcattccttttttcacttattagacagttatttagacaggatatgatgttcgatgaagaatatttcctagtaagtaaaaccaataaggtacttgttttctcacagcttagaaaatgacaagactgatgtgagacaaataagtataaaaataaacacataattacaaattgctgtttgtcttaataaggaaaaagactgccaat

SEQ ID NO: 77637 - DNA, 601 bp, Human
aggaaaaagactgccaattaaaggaataaaaagagaaactaaatttaggattaaagtaaggggatgtgaggggaaagactcccagagtacatctcaaaagaagtgacattatatctaaagatgtaaagaaaaagccaaatgaagggctttcagggagagggtctaggtgctgtttccttaagacaggaaagagctagaatttttgaggaatgaaaagaagccagtttattggaacacactgagtgagaggggtatggcagatgatgtttggagagttgaggggaagcagataatgtgtgcsctactggccaaaataagcacacaatcacctaaaacgggaaacatgtaaagacatgcatgtagatcttaaaaatatacatgataagtagagtgacctggggtaacacctaattgtacttttaaaacctactagttgatcggaagttcatggccagccaacagcatgacatggtagaaaaaaaaaaagcaaccaacaatgtgttttaacttttgttaatatgaatataaacctgtaaactaagtcagtttacagttgttaaattttcaccctgcctgcaaattttcttaaattcataccata

SEQ ID NO: 77638 - DNA, 601 bp, Human
aggaataaaaagagaaactaaatttaggattaaagtaaggggatgtgaggggaaagactcccagagtacatctcaaaagaagtgacattatatctaaagatgtaaagaaaaagccaaatgaagggctttcagggagagggtctaggtgctgtttccttaagacaggaaagagctagaatttttgaggaatgaaaagaagccagtttattggaacacactgagtgagaggggtatggcagatgatgtttggagagttgaggggaagcagataatgtgtgcgctactggccaaaataagcacrcaatcacctaaaacgggaaacatgtaaagacatgcatgtagatcttaaaaatatacatgataagtagagtgacctggggtaacacctaattgtacttttaaaacctactagttgatcggaagttcatggccagccaacagcatgacatggtagaaaaaaaaaaagcaaccaacaatgtgttttaacttttgttaatatgaatataaacctgtaaactaagtcagtttacagttgttaaattttcaccctgcctgcaaattttcttaaattcataccataaatattccacaagtatagctt

SEQ ID NO: 77639 - DNA, 601 bp, Human
atcttaaaaatatacatgataagtagagtgacctggggtaacacctaattgtacttttaaaacctactagttgatcggaagttcatggccagccaacagcatgacatggtagaaaaaaaaaaagcaaccaacaatgtgttttaacttttgttaatatgaatataaacctgtaaactaagtcagtttacagttgttaaattttcaccctgcctgcaaattttcttaaattcataccataaatattccacaagtatagcttcatcttaatataaaatgtcaattcagaaggagaagccttctrtatttccaaattacagattcattaacttataaaaattcacttcataatttcatactagtttgcctctcaacatgttttagcttcttaattgaaaccttttcatgagaaaaggagagttttaaaaacattgttccatccttgatgatagttatattttatctgaataaaaagtgattaaatcaacattaccacttatcagagcatttattaatttctcacctgcctttgatttcctttgaagaaaagttttctgaagctgactggagaataaaaatacaaacttcattttattaatgattt

SEQ ID NO: 77640 - DNA, 601 bp, Human
gataggtaagagatgctagttcagatattgtgaaagttatatgacaagagacctaaatgaaaagatgaagagagaagctacaagccatgctaaatgaggacaggaaaggaacaagctaggcaaggtagagcaaagacaaaggcccttgggtggagcatacttgatacatacaaggttagaaaaaagtgtgtgaggaaaagagaggtacgaagtacaatgacagagctagcgtgatccagattatattgttcacaggaaaggctttggagcttattctaagtgtgttcagaagccccagagrgtttaagcattagtattacctaatgcttaaggcttacctgagaagatcactctgactgtgcatgacttgtgtttttggaagacaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctg

SEQ ID NO: 77641 - DNA, 601 bp, Human
acaagagacctaaatgaaaagatgaagagagaagctacaagccatgctaaatgaggacaggaaaggaacaagctaggcaaggtagagcaaagacaaaggcccttgggtggagcatacttgatacatacaaggttagaaaaaagtgtgtgaggaaaagagaggtacgaagtacaatgacagagctagcgtgatccagattatattgttcacaggaaaggctttggagcttattctaagtgtgttcagaagccccagagggtttaagcattagtattacctaatgcttaaggcttacctgagragatcactctgactgtgcatgacttgtgtttttggaagacaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctggaaagatggtgatactattgaacaaaaggggaaacactaagga

SEQ ID NO: 77642 - DNA, 601 bp, Human
gccatgctaaatgaggacaggaaaggaacaagctaggcaaggtagagcaaagacaaaggcccttgggtggagcatacttgatacatacaaggttagaaaaaagtgtgtgaggaaaagagaggtacgaagtacaatgacagagctagcgtgatccagattatattgttcacaggaaaggctttggagcttattctaagtgtgttcagaagccccagagggtttaagcattagtattacctaatgcttaaggcttacctgagaagatcactctgactgtgcatgacttgtgtttttggaagayaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctggaaagatggtgatactattgaacaaaaggggaaacactaaggaagggtagtttggaggaagtagaaaagcaaaatttcttata

SEQ ID NO: 77643 - DNA, 601 bp, Human
tgacttgtgtttttggaagacaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctggaaagatggtgatactattgaacaaaaggggaaacactaaggaagggtagtttggaggaagtrgaaaagcaaaatttcttatatccctgtaaaactgagctgcctgttaggtatctaccaacaatgccatatgtagaagccaccatttaggaaaatcattaaagccatagacacaaatctagagttggcaatatacagatgctatttaaatccaatgccacattgagatcttctagggactgggtacagatagaaactacatcctaggaacaacaggcactctaactttagcgattaataatagaaggagaggacactaaaggaaactgaggaggtcccatgagttatgaggaaaattgggaa

SEQ ID NO: 77644 - DNA, 601 bp, Human
caggtaatgtgataccttcagcttcatttttttgcttaggatggatttgctagtcagacttttttggttccgtatgaattttaggatttacattggtaatttcataaaaattgtgttgaatctgtagattgttttgggcaggatggtcattttacacaatattcattattccaattcatgagcgtaggatgtttttctattttttttgtgacatatatgacttttttcatcagtgttttgtagttctcctcgtagagacttttttacctcttagtttaaatgtattactattttttatatycattgtaaatgggattaagttgttgatttgattttgagcttgatcattattgttgtatggaaatggtacttatttttgtacattggttttgtatcctgaaactttactgaagtagtttatcaagtctaagaggctttcagaggagtttttagggttttctaggtgtaagattatatcataagtgaagaggaataattcaaattcttcttttcccatttggagaccttttattcctttatcttacatgattgttcctgataggacttccaatactacgttgaatacgagtagtgaaagtgg

SEQ ID NO: 77645 - DNA, 601 bp, Human
tttggtttggtagaatctggcagtaagttcatctttttgttgttgtcatcaggagattttttaattattattactaattcaatttaattgctcattattggtctgttaaggatttctgtttcttcctggttcaaacgtgtgaggttgtatgtttccaggaatttatccatttcctctaggttttccagtttatgtatgtagagatggtcatagtagtctctgatgatcttttatgtttctgtggtaatagttttaatgacaccagtaatatttctgattgtccttatttgaatcttctttstttttggttaagctactagtaagctatctatcttacttatattttcaaattacaactttttatttcactgatcctttgtaatttttttgcccaaatctcatttagattttttctttgatatttactatattctgctagctttgggtgcagtttattcttgttttactagttctgtgagacgtgacattagattgttaattttatatctttctgtctttttgttgtgggcatttaatgctacaaacttccctcttggcactgatttgttgtatctcagaggttttggtatgttgtgtcttt

SEQ ID NO: 77646 - DNA, 601 bp, Human
ggtgggttttttgtatgcagcatatagttggatttttaaaaattcattctgccagactatattttttaagaagagtgtttagtatatttatatataaggtcagtattgatttttgaggggttgtttctataatattgttaattatttcttaattgctttgcagtctcaattaggtaattttaaaataagatctgtaagttttatactttgtgtgtttccataatgataagtattgctctttcatttctatatgttagaactccttcaagcctttcttgtagagtcagtctgtttgcgacarattcccttagtgtttgcttatttgggaagtactacttttcttcttgaattataagtcttagttgagcagtatacaaaattcttggctggcatttttttttttctttaagagactgataataagaccctaatttcttttggcttgtaagattcctgctgagaagtctgttgttagtctgataggattctttttacaggtaattagatacctctctcttgccacgtttaagatttttaaatttttgttgactttgagtagtctgatgactatatgtcttgtgctggttattcttgcaatgca

SEQ ID NO: 77647 - DNA, 601 bp, Human
gatgcagctctttgtatataggttcagagaaggcagaggattagatgaaagcatttttgcttgtctagtacagtaaaggatgagatggacaaaaatttacagaatatatgcagatgagcaattataacaaaagatcatgatgagaaaggaagtgaagaggtaaaactagatatgacctgtgaagaggttaggggaatcatagcctaaagagctagggctggagcttcttgtaacagatatattaaagggagtaaatttaaaacttaggaggtagttatgaggactgggatggccaaaatgsagaattttaaaagtgggtactgatgaactgactgtgggtggaagactttccagaaaagaggtcaagaaactgaaaggccagagaacattgggagcataatctatatgatctatatttcctaaaataactaggaaaaagggcagaaataattttcacaaaaatgacagggagtttggaatgaaaattgtcaagaaatgatgagagttgtgatgtgccattctatagctaacttcagcaaggaggttagagaatagtatggtagggtggtgcacttcttcttgggacctagaggtctgtcag

SEQ ID NO: 77648 - DNA, 601 bp, Human
ttgtgtgtgtagtataccgacaaagtgtaacttctgaaaatcaagtacagtgaaaaatacatgtcaggctattgtcaaaaaactcaaccagggttgaagtgcaatctctcccttcccaaaatctcctttgagaaatctgatatttgagagtaataactaaatagataagttaaactcccctttctactgatttcttcttgaccatctctttatgaaataaacttcctcctaaatagcaggcatggattctgtattcatttgtttttatgctgctgataaagacatacccaagactgagcartttacaaaagagggaggatttagttggaattacagttccacgtggctgggtaagcctcacaatcatagtggaaggcaaggaggagcaagtcacatcttacatgggtggcagcaggcaaagggagcttgtgcaggaaaagtacgcattataaagcaatcaaacctcatgagacttattcactatcatggaacagcatgggaaagaccacgattcaatgatctcccactgggtccctccaacaacacgtgggaattatgtgagtaaaattcaagatgagatttggtggggacacagagccaa

SEQ ID NO: 77649 - DNA, 601 bp, Human
acttcctcctaaatagcaggcatggattctgtattcatttgtttttatgctgctgataaagacatacccaagactgagcagtttacaaaagagggaggatttagttggaattacagttccacgtggctgggtaagcctcacaatcatagtggaaggcaaggaggagcaagtcacatcttacatgggtggcagcaggcaaagggagcttgtgcaggaaaagtacgcattataaagcaatcaaacctcatgagacttattcactatcatggaacagcatgggaaagaccacgattcaatgatytcccactgggtccctccaacaacacgtgggaattatgtgagtaaaattcaagatgagatttggtggggacacagagccaaaccatttcattccacccctgtcccctccaaatctcatgtcctcacatttcaataccaatcattctttcccaacagtcccccagaatcttaactaatttcagcattaacccaaaagtccacagtccaaagtctcatctgagagaagtcaagtcccttccacctatgcacttgtaaaaacaaaagcaagctagttacttcctagatacaatgggggtacagg

SEQ ID NO: 77650 - DNA, 601 bp, Human
tatccctgtggctttgcagggtatagcctccctcctggctgccttctcgggttggcgttgagagtctgcagcttttccaggtgaatggtgcaagctgtcggtggatctactgacagcttctgggatctggaggatggtgaccctcttctcacagccccactaggcagtgccccagtagggactctgtgtgatggctttgacctgacattttccgttcatactgccctagcagaggttctctatgagcaccttgtccctgcagcaaacttcttcctgggcatccaggcatttccatacatcytctgaaatctaggcagaggttcccaaacctcaattattgacttttgtgcacccacaggctcaacaccacatggaagctgccaaggcttggggcttgcaccatgtgaaggcacagcccaagctctacattggtccctttcagccacagctggagcagctgggatgcagggcaccaagtccctaggctgcacatagcacagggaccctgggcctggctcaggaaaccatttctcctaggattccaggcctttgacgggaggggctaccatgaagacttctcacatgtcctaaagacattttc

SEQ ID NO: 77651 - DNA, 601 bp, Human
ctagggcaggggcaaaatactgccagtcttttcactaaaatatgacaagcatcatctttgctccagtttccaacaagttccttatctccatctgagaccacctcaacctggaccttattgtccatatcactatcaggcttttagccaaagctattcaacaagtctctaggaagttccaaactttcccatattttcttgtttttttctgagccctccaaactgttccaacctctgcctgttacccagttccaaggtcacttccacattttcaggtatctttttagcaacgtcccactctacyggtaccaatttactgtattagtttgtttttacgctgctgataaagacatacctgagactgggcgatttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcaattatctcccaccggatcc

SEQ ID NO: 77652 - DNA, 601 bp, Human
gtttccaacaagttccttatctccatctgagaccacctcaacctggaccttattgtccatatcactatcaggcttttagccaaagctattcaacaagtctctaggaagttccaaactttcccatattttcttgtttttttctgagccctccaaactgttccaacctctgcctgttacccagttccaaggtcacttccacattttcaggtatctttttagcaacgtcccactctaccggtaccaatttactgtattagtttgtttttacgctgctgataaagacatacctgagactgggcgwtttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcaattatctcccaccggatccctcccacaacacgtgggtattatgtgagtaaaattcaagatgagatttaagtagggacacagagc

SEQ ID NO: 77653 - DNA, 601 bp, Human
agcaacgtcccactctaccggtaccaatttactgtattagtttgtttttacgctgctgataaagacatacctgagactgggcgatttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcarttatctcccaccggatccctcccacaacacgtgggtattatgtgagtaaaattcaagatgagatttaagtagggacacagagccaaatcgtatcagattcattgtcctcagtgtagttttgtgccctcagctgtgctaacaaagtgctgctgtcctttgtcaaagcagggccaaaacacactttctgtttattgtctctcctaatagataactattttagatttaactttcaatgtattatgtttaatttagtttttgtcttttaaaattttataagcgctattgaattcttttcagaat

SEQ ID NO: 77654 - DNA, 601 bp, Human
actgtattagtttgtttttacgctgctgataaagacatacctgagactgggcgatttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcaattatctcccaccggatccctcccacaacaygtgggtattatgtgagtaaaattcaagatgagatttaagtagggacacagagccaaatcgtatcagattcattgtcctcagtgtagttttgtgccctcagctgtgctaacaaagtgctgctgtcctttgtcaaagcagggccaaaacacactttctgtttattgtctctcctaatagataactattttagatttaactttcaatgtattatgtttaatttagtttttgtcttttaaaattttataagcgctattgaattcttttcagaatctcaataaatggcagttctctggcaaggta

SEQ ID NO: 77655 - DNA, 601 bp, Human
gctgtcctttgtcaaagcagggccaaaacacactttctgtttattgtctctcctaatagataactattttagatttaactttcaatgtattatgtttaatttagtttttgtcttttaaaattttataagcgctattgaattcttttcagaatctcaataaatggcagttctctggcaaggtatagaggcaaatatgtgtacatgaaactgaggtttagagtgctagctcattgtgttggattcttataacatatgagataagcattatcatgcccacttagcaaacaaggaaactgaggcyaagagagattaagtgatatacttctacaagtcatttggatgagagaaagcataatttgtctatttactttcaagaatattaactagcatggtatctcttagtaggtgcttagtgaatgtttcttgattgatggtggttacttagctctctgaaaaaaaccatccaacacttcgaggagaaaaaaaccctttttatcagttaattcaacatttcagtaaaagtgggttatttgagccacagtcatccacctcatcccagctctcctcctttactaatgaaagataatttcatttctcttgg

SEQ ID NO: 77656 - DNA, 601 bp, Human
attatcactcaggtgtttaccttttaaaacagttgaaaatgtaactttatataacgtgggaaattcacttaagagtattcattctaccagggagaggaatgatgctgataaatgttttgatattaactcagtttgattttttaatgacatgtattatttctttgcctttatcatatttcaggattgttcaacctgaattgaaagcacttgcaatgggtttccagtcaatggttataagaacactaggtatgacaaatatatagattatacattttaacatataaatattaatgttaaataytaaagactgaatgcaattaattttcaactataagactgtataaaaaagaataggtaagaatcatttctattttgtgataagtgaaaataaaaaggaacgggaaaattgagtggtctaaaagataatttgatgttaattctagttagagtcaatctgttaagagcaaggaatcatcatatttatattatattctttctaacagaaacagaaagataggtggtctctgaggttttccttctttcaggaaaataagaatatttctcccaggtatacgcagagaggaggaccttccttccaaat

SEQ ID NO: 77657 - DNA, 601 bp, Human
ataaatattaatgttaaatactaaagactgaatgcaattaattttcaactataagactgtataaaaaagaataggtaagaatcatttctattttgtgataagtgaaaataaaaaggaacgggaaaattgagtggtctaaaagataatttgatgttaattctagttagagtcaatctgttaagagcaaggaatcatcatatttatattatattctttctaacagaaacagaaagataggtggtctctgaggttttccttctttcaggaaaataagaatatttctcccaggtatacgcagagwggaggaccttccttccaaatggagacattacttaggacagccctaaagtagcttgggaaccctgggaatctggtcaggctgaggttgtctagaacaacagaagctgacattcactgtgccatttcccactgcctggtcctctatggctggacagctaaccattagcaggagttaatgcaaaagggaatgaaaattcatactctagaactaggcttgttggattatgaggatgtcctgaataaaagaaagctcagaaaattgtggtttatggtggcaagggtaggattttagactctagag

SEQ ID NO: 77658 - DNA, 601 bp, Human
aagagtagatcaaatacatctgtgacattaccatatgatttaagcctttgcgatttctaataattttgattcctgggtggatgtaagccaaaccaatggaataattttccaaaactttaaacttgtattaatccaaaatgtatcaatatcgactatcgctcagttacatttgaagcatttcacttggattgatatctttttatctcatgttgcaggaggaattctagctccaatatattttggggctctgattgataaaacatgtatgaagtggtccaccaacagctgtggagcacaaggrgcttgtaggatatataattccgtattttttgggtaagttgtcgtaaacacatttcattaatagattttttctttgtctatgttaatgtctaagatatagcatttttagtgtgatcgtaatattaatgatagctaccatttagtgaacaattactttgtattcactattgtatcaagcattctggtatctcattttaatactcatagaaactgtaggaaatgtatatattcctcctttttccttaaatatgaagaaaacaagattgaagaataatgagtaacttgtcaaaaattgcacaac

SEQ ID NO: 77659 - DNA, 601 bp, Human
caaggggcttgtaggatatataattccgtattttttgggtaagttgtcgtaaacacatttcattaatagattttttctttgtctatgttaatgtctaagatatagcatttttagtgtgatcgtaatattaatgatagctaccatttagtgaacaattactttgtattcactattgtatcaagcattctggtatctcattttaatactcatagaaactgtaggaaatgtatatattcctcctttttccttaaatatgaagaaaacaagattgaagaataatgagtaacttgtcaaaaattgyacaactaaaagaaatacagctaggatttgtacttgaatctcttttgattacaaagctctctcccactggcttctccaggaagacacagaatgaccagctgcagctctggttatatggtaattgaggaaagaaatggaaaaacaaagtttcattactcttctattcataggcagaagtatcctgcaagtgacattaagacaactagattatctggaagaaacaaaaagctgctgcaattgtaccttacctcttatagaagcattaatttgtaatttatatattgatcaatatataaatttg

SEQ ID NO: 77660 - DNA, 601 bp, Human
agaaacaaaaagctgctgcaattgtaccttacctcttatagaagcattaatttgtaatttatatattgatcaatatataaatttgatttctgaaactataagtattagaactactcatagtagaatttcttttaattatctaggaagaataaatgtgtttgtaagtatgacccaaatgcctgaaagtataatagaaaaataatggtgaaaggatttatattgctttgtgtatatacccaataataggactgatgggttgaatggtaattctgttttatgttctttgagaaatcgtcagacygctttctacaatgacagaacttatttacattcccactagtagtgtataagcgttcccttttctccactatgtcttcagtatctgttattttttgacccactaaaaatagccattctgacttgtgtgggatggtatctgattgtagttttggtttgtagttctctaataattagtgatgttgaatcctaattgaactaatgcatgaacagaaaaccaaatatcacgtgttctcccttgtaagtgggagctaaacattaagtacatatggacacaaagaagggaacaatagacactggagcc

SEQ ID NO: 77661 - DNA, 601 bp, Human
cccttgtaagtgggagctaaacattaagtacatatggacacaaagaagggaacaatagacactggagcctacttgtgggtgcagagtgagaggagggtgaagaaacaaaactacctgtaagtgactatgcttatttaaaaagagaaagagaacaagaacagataataaaatattttaaaaactgcattacacaacgtattgtaagcaaagttcaacagcaaggggtaaattagaagaatttataattcagagatagacacaaccaaatgtcctatgtatataaggatctcttaaaaatctmcaaaaacaggccggatgcagtggctcacaactgtaatcctagcactttgggaggctgaggcaggcagatcacttgagaccaggagttcgagaccagcctgacaatcatggtgaaaccttatctctagtaaaaatacaaaaaaaaattagccaggcattgtggtacatgcctgtaatcttagttacttcagaggctgaggtgggacaactgcttgaacctgggaggtggaggtggcagtgagctgagatcaccaactgcacactccagcctgggcgacagagcaggattccatctcaaaaa

SEQ ID NO: 77662 - DNA, 601 bp, Human
attgtggtacatgcctgtaatcttagttacttcagaggctgaggtgggacaactgcttgaacctgggaggtggaggtggcagtgagctgagatcaccaactgcacactccagcctgggcgacagagcaggattccatctcaaaaaaaaaaaaaaatcaatgcaaacatcaaatgctagcaagaatgggaaacaacaggaatttcctgtcattgctggaggtgatgtaaaatggtactggagtgttggaagacagagtgaaattttcttacaaagcaaatagagttattgtacgattaagcmatcatgttcccaggtatttacataaattagttggagacatgtccacaaaaaaacctgtacttgaatataaaaaagtggaagcattgaagatgtccttcggtaggtaaatggataagtaaactatgttacattcatatagtggaatattagtaatcaatgtattagtctattctcacactgctatgaagagctacctgagactgggtaattcatgaagaaaagaggtttaattaactcccagttccacaggcttaacaagaagcatgacttggaggcctcagaaaactcacaatcatggca

SEQ ID NO: 77663 - DNA, 601 bp, Human
ggtgggacaactgcttgaacctgggaggtggaggtggcagtgagctgagatcaccaactgcacactccagcctgggcgacagagcaggattccatctcaaaaaaaaaaaaaaatcaatgcaaacatcaaatgctagcaagaatgggaaacaacaggaatttcctgtcattgctggaggtgatgtaaaatggtactggagtgttggaagacagagtgaaattttcttacaaagcaaatagagttattgtacgattaagccatcatgttcccaggtatttacataaattagttggagacatgkccacaaaaaaacctgtacttgaatataaaaaagtggaagcattgaagatgtccttcggtaggtaaatggataagtaaactatgttacattcatatagtggaatattagtaatcaatgtattagtctattctcacactgctatgaagagctacctgagactgggtaattcatgaagaaaagaggtttaattaactcccagttccacaggcttaacaagaagcatgacttggaggcctcagaaaactcacaatcatggcagaagcctaaaaggaagcaaggcatgtcttctcctagtgacag

SEQ ID NO: 77664 - DNA, 601 bp, Human
caggcttaacaagaagcatgacttggaggcctcagaaaactcacaatcatggcagaagcctaaaaggaagcaaggcatgtcttctcctagtgacaggagagagagagggagagagcaaagggggaagtgccacacacttctaaaccaccagacctcatgagaactcactcactatcttgagaacagaaagggagaaatccacccccaagatccagtcacctcccaccaggttccttctccaattcaacatgaaatttgggcagagacacaaacccaaaccatatctttcaatccctggtcrttcccaaatctcctgttcttctcatattgcaaaatacagttacccttctcaacagtccccgtgtcttaactcatttcagcattaactcaaaagcccacagtccaaagtctcttctgagacaaggtaagtcccttccacctatgagcctattaaattttaaaaagttagttacttctggccaggcgcggtggctcatgcctgtaatcccagcactttgggaggccaaggtgggtggatcacgaggtcaggagattgagaccatcctggttaacacggtgaaacctcatctttactaaaaat

SEQ ID NO: 77665 - DNA, 601 bp, Human
accaccagacctcatgagaactcactcactatcttgagaacagaaagggagaaatccacccccaagatccagtcacctcccaccaggttccttctccaattcaacatgaaatttgggcagagacacaaacccaaaccatatctttcaatccctggtcgttcccaaatctcctgttcttctcatattgcaaaatacagttacccttctcaacagtccccgtgtcttaactcatttcagcattaactcaaaagcccacagtccaaagtctcttctgagacaaggtaagtcccttccacctatragcctattaaattttaaaaagttagttacttctggccaggcgcggtggctcatgcctgtaatcccagcactttgggaggccaaggtgggtggatcacgaggtcaggagattgagaccatcctggttaacacggtgaaacctcatctttactaaaaataccaaaaaattagccaggcattgtagtgggtgcctgtagtcccagctacttgggaggctgaggcaggagaatggcatgaacccaggaggtggagcttgcagtgggccgagatcacaccactacactgcagcctgggcaacaga

SEQ ID NO: 77666 - DNA, 601 bp, Human
gttaacacggtgaaacctcatctttactaaaaataccaaaaaattagccaggcattgtagtgggtgcctgtagtcccagctacttgggaggctgaggcaggagaatggcatgaacccaggaggtggagcttgcagtgggccgagatcacaccactacactgcagcctgggcaacagagcgagactctgtctaaaaaaaaaaaaaaattagttacttccaagatacaatgggggtacaggcatttggtaaatactcttattccaaatgggagaaattggccaaaacaaaggggttacaagcyccatgcaagttcagaacccaacagggcagtcattaaatcttaaagctccaaaatgatctcctttgactccatgtcacacatctagggcacaatgatgcaagagatttgtgcccaaggctttgggcagctccactcctgtggctctgcaggtacagtccccatggctgctttcatgggctggtactgagtgcctgcagcttttccaggcacacagtgcaagctgttggtagatctaccattctggagtctggaggacagtggccctcttcttatagctccactaggtagtgcctcaatggg

SEQ ID NO: 77667 - DNA, 601 bp, Human
aaaattagttacttccaagatacaatgggggtacaggcatttggtaaatactcttattccaaatgggagaaattggccaaaacaaaggggttacaagccccatgcaagttcagaacccaacagggcagtcattaaatcttaaagctccaaaatgatctcctttgactccatgtcacacatctagggcacaatgatgcaagagatttgtgcccaaggctttgggcagctccactcctgtggctctgcaggtacagtccccatggctgctttcatgggctggtactgagtgcctgcagctttyccaggcacacagtgcaagctgttggtagatctaccattctggagtctggaggacagtggccctcttcttatagctccactaggtagtgcctcaatgggaactctgtgtgggaagtccaaccccacattttctctctgtactgccctagtataggtttttcatgagggctccacccctgcagcagacttctgcctggacatccaggctttttttttttttttttttttttttttttttttcttgagacagtgtcttgctctgatgcccaggctggagtgcagtggcatgatctcagcttcc

SEQ ID NO: 77668 - DNA, 601 bp, Human
caggctggtgataggaggggcctccattaaggtctctaaaatgtcctagagatattttccccactgtcttggctattaacatttggatcctctttacttatgcaaatttctacagcaggcttgattttattctcagaaaatgagtttttcttttctaccacgtggctgggttgcatattttccaaacatttaaatgtaagttccagtttcagataatctctttgttcacacatatgagtaaacacttttagaaacagccaggtcacatcttgaatgctttgctgcttagaaatttcttccrctagataccctaaatcatctctctcaagttgaaagttccacagatctctagagcagggacaaaatgccaccagtctcttagctaaagcatggcaagagtgacctttactccagttccccataagttcctcatctccatctgagacaatcctgaacttcattgtccatatcactagcagcattttggtcaaaaccattcaacagtctctaggaagtttcaatctttcccacatcttctgtctccttctgagcactcctaactgtttcaacctctgctcgttactcagttccaaagttgttt

SEQ ID NO: 77669 - DNA, 601 bp, Human
catttggatcctctttacttatgcaaatttctacagcaggcttgattttattctcagaaaatgagtttttcttttctaccacgtggctgggttgcatattttccaaacatttaaatgtaagttccagtttcagataatctctttgttcacacatatgagtaaacacttttagaaacagccaggtcacatcttgaatgctttgctgcttagaaatttcttccactagataccctaaatcatctctctcaagttgaaagttccacagatctctagagcagggacaaaatgccaccagtctctwagctaaagcatggcaagagtgacctttactccagttccccataagttcctcatctccatctgagacaatcctgaacttcattgtccatatcactagcagcattttggtcaaaaccattcaacagtctctaggaagtttcaatctttcccacatcttctgtctccttctgagcactcctaactgtttcaacctctgctcgttactcagttccaaagttgtttccacattttcacatatccttatagcagtgtcccactcccagtaccaatattctctattagtctgcctcagaaaacttac

SEQ ID NO: 77670 - DNA, 601 bp, Human
aagactgtgttggcaaagtatataactttgagccaacagcaatacttctaggaatttatcctaaagatatctatactcccaaaatactgaaaacaaagtaagaaccaatcaagaagatatcaattaaattaataatgtgcatgcaggcaaatgaatattctgagttcttaaaaaaaggaaaaatctttttacttactaatatggaaggctattcacaatatattggtatattcacatatatattatgtgaaaaaaggaagcattacatgaaaaatgtgtgcggaatatgctattatttatrtaaggtggggaatatttcttagttcaggttagatctctggtgaaaactccctggatctaatttactaaaagaactttcttctacctgatgtgtaaattcactgtctaacatccccaacaagtaatgatccagatttttctggaattacagtaaagcagcattcagcagcccacagacattctcttaaatttaaaataattatagaaaatctttccctaaatgggagatttctttcctccctccctccccttccttctttccttccttcccttcctttcttcctcccccttcccttcccct

SEQ ID NO: 77671 - DNA, 601 bp, Human
ccttccttcccctcccttccccttccccttccccttcctcttctcctcccttcccttcccttcctttttttttttttttgagacgcagccccactctgtcatccaggctggagtgcagtagcgaaatctcggctcactgcaacctccgactcctgggttcaagcaattctcttgcctcagcctcctgagcagctgggattacaggcgcccgccattacggcaggctaatttttttgtatctctactagatacggtttcgccatgttggccaggctagtctcaaactcctgacctcaggtgrcccgcccacctcagtctcccaatgtgctgggattacaggagtgagccactgctcccggctgggagatttcatttctatttataaaagtatggaaaaaaataacaaagaaaaacttaataaatttactttaagaaaatatttattttaattgaaatcataattcattttaaggacaactggcaagatgctccccagaatctccccgaagcaataatcaccaagtccaagcattagcataacattttgaaatggtgatactttagttatgttagtttcagtatgaaaaggccactaaaacat

SEQ ID NO: 77672 - DNA, 601 bp, Human
cagtaaaggtttaggtaaaagtaaaaggaaatgaaaagtggaattttaaagtataataaaaaaatttaaaaaagggcagttcatttgccagttaatacactgaaagttaaataattaccttatgatttttaatagattttattttttagaatagtttcagaatcacagtaaaattgaggagaaagcacagagatttcccatatcttgcctgctcccgcatacatgcatagccttccccattatcaacatctcccatcaggatggtacatttgttacaattgacaaaccagattgacacatstttatcactcaggatccacagtttacatcaggtttcacatttagtgttgaactttctgtgggtttggatgaatgtaaaatgatacataaccaccactccactatcataaaaagtagtcttgctgccctaaaaatcttctgtgctctgcctgttcattcatcctttcccagtaatccctggatccctagaaaccaatagtctctttactacttccacaattttgtctgcttcagatcatatagttggaattatacattttgtagccttttcagagtagcttctttaactcagtaatatgca

SEQ ID NO: 77673 - DNA, 601 bp, Human
taaataaaagttaataataaaagttatccatgtgccagtttttgtatagatacaggtctcaacttctttgtgtcaacaccaaagtgcaattacttgatcatatgataaaaatatgtatagttttataagaaattgtcagactggcttcaaaagtggctgtatcattttgcattttgaccaacaatgaatgagagtttctattgctccacttccttatccacatctaatgtctagtgttctggattttggccattctaataggtatgtagtggtatctcattgttgtttaaatgtgcatttscttgatttccttgatgacataagatgtgaagcatctttttcttttttttttttttttttgagacagagtatcactctgtcgcccaggctggagtgcagtggcatgatctcggctcactgcaagctacgcctcccaggttcacgccattcttccacctcagcctcccgagtagctgggactacaggcacccaccaccacgcctggctaattttttttttttttgtatttttagtagagacagggtttcgccatgttagccaggatggtcttgatctcctgaccttgtgatccgcccgcctt

SEQ ID NO: 77674 - DNA, 601 bp, Human
taaatgatttgtgaatgttgaacctgtcttccaaacctggaatatatgcctggataactgttttattcagaggttttaaattgtaatgaagtcctctttgtcaataagttctttcatggattgtgcttttgctgttgcatctgaaaagtcataaccgaatcctaggttgcttactcctgtgttacgtcctaggagttttatagttttgcattttacgttttggtttgtgattcattttgagttaatttttgtgaagcctaaattcattattttgcatgtggatatctaattgttccagcaycatttgttgcaaatactatattttctccattgtagtacctttatgtttttctacagatccattgactgtatttaagtgggtctatttctgggctatttattctttccacttacctattcgtatattattttaccaaagtcacactgtcttggttgctgtagcttcatagtaagtcttgaggtcaggtagtatcagtcctattattgtgttcttacacttaagtattgtcttggctatttagcatcttttgcctcttcacataaactttagaattagcttgtcaatatccacaaaataact

SEQ ID NO: 77675 - DNA, 601 bp, Human
aattctcctctattcctagtttaatgaaagtttttgttcacaaatggatgtttgattttgtcaaatgcattttctgcatctattgatgtgatcatgtgatttttttcttctttagcatgttaatataataaattatataattgatttttgaatgttggaccagtcttgtaaacctgaaatacattccacttggttgtggtgcctaaattgttaatgcaatgtcaaattcaattagctatttttgagaacttctgcacctgtatttgtgagatgtatcgctctgtagttttcttttcttgtratgtttgtctgctttgggtattaggataatgctgacctcataggagacaggaagtattcctgctgcttctattcctctgtaggaaattgtaatgaattggtataaattcttacttaagtgttttatagaattcgcccatgaacccatcttggtttggtgttttctgctttagaaggttattatcaattcatttctttaacagatatagatctattcagatagtctgtttcttcttgtgtgaattcaggtagattgtatctttcaaggaattggtccatttctttcaggttattaaaattg

SEQ ID NO: 77676 - DNA, 601 bp, Human
aatttcatcttgacccatatgtttcttagaagtgtattgcttaatcttcacagattttgagactttccaatgatctttctgttgttgacttctagtttaattcccttgtggtttaaggacagatattacatgattttcattctttcaaatttcttctattttatttttatttttatttatttatttatttatttatttatttatttatttatttattttgagaccgtcttgctctgttaccaaggctggagtgcagcagtacgatgtcactcactgcaacctctgcttcctgggttcaaamaattctcgtgtcttggccttctgagtagcggggattacaggtgtgtgctatcacacctggctaatttttttttttttttttgtattttttcttttcttttcttttttttcagatggagtttcactgctgtcgcccaggctggagtgcaatggtgcaatctcagttcactacaacctccacctcccaggttcaagtgattctcctacctcagcctcctgaatagctgggattacaggcctgcacccccacacccagctaatttttgtatttttagtagagatggggtttcaccatgttggc

SEQ ID NO: 77677 - DNA, 601 bp, Human
agaacctgtagacaatgttaagtgaagacttactgcatttctctttgcagctctatcattttctcctcacatatttagacactccatttttacatgcttacatgttaagtattgttctgttttgtaaaaggataataggataactgatttctttgttattatgtaaagacttttttatccttcataaatttccttgctttgaagtctgctctgtttgaaattaaaaaattaaaataggtactcccattttcttttgattaatgttatcagtgtatatcttcctcagtctaattacttttawtctgtatgtcttcatatttaaagtgagtttcttgtagactacatatagtttggttcttggttttaatcctctaacaatcttattgttatcttttgagatggggtctcactctgctacccaggctgtagagcagtggcttgaacatggctcactgtagcctcaacctcctgggctcaagagatccttctgcctcagcctcccatgtagctgggaacacaggcatgaactaacatgcctagctaattttttgattttttgtttgtttgtttgttttagagatgggcaactctgttgcccagt

SEQ ID NO: 77678 - DNA, 601 bp, Human
catgtatattatatataattaaatacattgtttctattattattttaaagaaactgatttctattaaatcaatttagaataatttttttatttaaccttaactgatttcttctctgatattcttccatctttatgtatatccgagtttatgacctatatcattttccttctaacaaacttcttttaagatttcttgcaaggagagtctactggcaaaacagtccctcaatttttgtttgtatgacagtgtctttatttcgacttagcttttgaaagataatttcatatggtacagaatttktaagttggtgttttatttttcttaacagttaaatatttcacttcgctctcttcttgcttgcatggtttctgaagagaaggctgatgtaatcttttctactctataaataaggtttgcttttccttttggtttctttcaggatgttttcttcatctttgattttctatagcttgaaaataacaaacctatgcatagtttttctggcctttatccttcttggtgttttttgagcttcctggatctgtggtttggtgtctgacattaattcaataaaaattttctgtacttattatttgaaat

SEQ ID NO: 77679 - DNA, 601 bp, Human
ttaaagaaactgatttctattaaatcaatttagaataatttttttatttaaccttaactgatttcttctctgatattcttccatctttatgtatatccgagtttatgacctatatcattttccttctaacaaacttcttttaagatttcttgcaaggagagtctactggcaaaacagtccctcaatttttgtttgtatgacagtgtctttatttcgacttagcttttgaaagataatttcatatggtacagaatttttaagttggtgttttatttttcttaacagttaaatatttcacttygctctcttcttgcttgcatggtttctgaagagaaggctgatgtaatcttttctactctataaataaggtttgcttttccttttggtttctttcaggatgttttcttcatctttgattttctatagcttgaaaataacaaacctatgcatagtttttctggcctttatccttcttggtgttttttgagcttcctggatctgtggtttggtgtctgacattaattcaataaaaattttctgtacttattatttgaaatctttattttgttcctttcattttccccttcaagtattttcatta

SEQ ID NO: 77680 - DNA, 601 bp, Human
agtagcatcctgtagttctatgataaggcctcaatcttttagtgagcctgtacctctggactgtgaacttcaaacttgcttctcagtttctgtctcccactccttaggtagaatgagatggcttgagggggctggagttatgtattttccttcctcccaaaggaaggctagagacagctggggtttagtttctgtagcttcatatgtttttttaataatagaaaaatatcttatgcccccaatgaaaataataaatagaattgttctcttaatatttgtatgtgtaacttgtttttctttyttttaagatatgcatactggggagaaaaaaatgtaagatattttacacatttaaaataataatcgactctctattttctcttttcacagaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaat

SEQ ID NO: 77681 - DNA, 601 bp, Human
tcatagagataaaatctcttgagatagtcctattgaaaagagagtaattaatctatagttcttgtttattatattcttttatcttagaagcctatatatctcttgcctttggttcctgtgaattcaaataatgatttgaagacagaataattacatagtcacagagaaaaataagtgtgcattagtgaggagaaaatttaatattgctaatgaagcactggcgtgccatttcgtgagcaaaagaaaagaatccctcaatttttaaaaaatccatttaaatgttttggggagaattacactrtacactttataaagcctagaagtgtgtaagagcaatcaggaagcatgtaccagtctgtcctcaggggtacgactgggacattctctgtgttatcatagaccctgtgggggagatctgaggtcaaccagccctatctaaagtccagctgagatgcggttccagctaaaagttaaagggtcttaaaattttagctctgggaaaagatattaggaaattattaaatagttcaatttaataatccggtgaaggaaccaaagcttatagcaactaaatgatttatgtgcccaggttcacacctta

SEQ ID NO: 77682 - DNA, 601 bp, Human
catacaactttcctgaaatgcagggggatctctttgccccacatgtttaaagcctttgacactaatcgatccactgtaatatgcggtaagtctcgagtatatgatacgatcctagtagcaaacaagaaaacaatgtttgacccctaggaaacaggctttattgtttttgccaaaatgagccagagcaaaactaacctgtaggtgaccactttggaagtccattttgggctatttggaaatagtgagtattctgcaacatctggcactccacatctgggcttctgcattatttctatgacgygggagtttaacattccagttataggtaggccaaagaatttttgcatctccttgagtttggcttctaaactgttggcattttttgtttctgagtcatagagataaaatctcttgagatagtcctattgaaaagagagtaattaatctatagttcttgtttattatattcttttatcttagaagcctatatatctcttgcctttggttcctgtgaattcaaataatgatttgaagacagaataattacatagtcacagagaaaaataagtgtgcattagtgaggagaaaatttaatattgct

SEQ ID NO: 77683 - DNA, 601 bp, Human
cttttgagacatagtcttgctctgttgcccaggctggaatacagtggtgtgaccttggctcattgcaacctctgcctcccaggttcaagcgattctcatgcttcagcctcccaagcagctggaattacaggcatgcgtcaccatgctcagctaatttttgttttagtagagatggggtttcaccctattggccaggctggtcttgaactcctgaccgcagatgatccacctgccttggcctcccgaagtgctgggattacaggcgtgagccaccacaccctgctgtgttatatatttttawgttctttaatatgaaagtttccatttcctacttccttgccacatgaaaggcattagcaacaggtcatataccacttctcaggggactcttgaggcctttggaagctgcgactctttctgttgatttaatatcgatgttaggtagatatattgtaaacatatagtcatgtgctacataatgatctttcagtaaacagatcacatatacaatggtcctataagattataatggagctgaaaaattcctatagcctagtgatatagtagttgtgataatgtcatagctcaatacattaccttt

SEQ ID NO: 77684 - DNA, 601 bp, Human
caaaaatttggacatggtggcacatgccaccaagtagtaatcccagctacttgggaggctgaggctggagaattgcttgaactcaggaggcggaagttgcagtgagctgagatcgcgccactgcactccagcctgggtgacaacagtgaaactccatctcaaaaaataaattaaaaaaaaaaaaaaggcagcccagtgcaagtagctgacattgttatgtgctgtcggttgcactcacagggtagtttgggtgctttcttggcccagacacttttcctttcacagaaccattgctcatcamtgataatcaccatatattgaaagcttactggatacaggacttaaaatgcagttatatctaacttaaggttgcatttaagcttttgttaaatttgaccactttgctcggccaaagggtggtgggagggagaatgaatatgaataccacatttggcaagtaatttgtgcaccatttcataggtttttttttttttttttcttaaaaacctagcttattcttcgtgggcatagtaaatagtctcttagagagccatgctcaagatctcttaaaatggctttttatagtcctttaatgtgtgat

SEQ ID NO: 77685 - DNA, 601 bp, Human
ttaatatcatcctgggaaagtttaaaattttggggatctccatttccataggttggatacatcactgcattaggatcagaggaatgtcccatacccaaagaatggccaagttcatgagttgcagcatacaggaagttaatccctacaaccgaagaagtgacaaacagtaatgataaaaatagctacatacattatgtaatattatatatatgatatcataatttaaaaaaactaaagaaaaatacccaagttttagcccacggtagcttacttatttgtttctaggctttcaaaagtggaraggggttagaaggttaatcagaataggagtgctttaatctcatcactacttctgcttattaaaaatgtgtaattttttttatttgcttctttcattcaggcagcaatactctgcagtggaaagcaaaggttttaaaagcactaagacctaggtttgaaatgtagctccactacttactagctggacaactctggacagattaattgatgttgctgagtctcagtttctcatctgttaaacagagacagtaatttctgccctctagatttgtcatgatagctagagtttctcaatatttgg

SEQ ID NO: 77686 - DNA, 601 bp, Human
cttcacgcccggctaatttttgtatttttagtagacatggggttttaccatgttgtccaggtctcgagctcctggcctcaagcgatccccaaccaccttggcctcccgaagtgctgggtaaaggcgtgagccaccgcgcccagccagctattatttttatcattctgagtatagcattaggaatcttgtatcttaatcactttctttggaatctatgttttctgctcatattactttttagattaactccctacatatacagcccacataattaaattctatttccatttgtccagaagtkacttgtttccaactctgaccagagatgcccttttgtctaatacttaaggttttaatgcactagtctcttttcttcctgttaaatttaatcagcatgcctcagaccttctttagtctctttgtatttttcttagggttctaaaatatttatagactgctatagaatattccatgagttccacagttttatgtaaggggaggatagtattttcagttttgttcatgataactttacgaacaatagtcagcattttgtgaatcttttggacagcagtggttctttacgtcgtaacttttggga

SEQ ID NO: 77687 - DNA, 601 bp, Human
agggtgaggtgctgcggaagacctcaaaatagtgtggtgggattctttttttgtcttagtctttcgtttcattgtatagtatgtcttcacagaaagagtgctccaaactataaataaatttaccatggaataaacattttatttatttgtgtatgtaacatttattgacatctacccactgcaagtatagatgaataagacacagtcacaccataaaggagtttatccttaaaaggagtgaaagacattcaaaaaccaactgcaataaaaaagggtgacataattgctaaatggagtggargaacagtgcttatcaattctgattgtgcaacaatgatatacaatccaatgaatgaatgaatggatgttctgcctgaagtttctatttctttcttgaattacttctctttcctattgagagaaaaaaaaagaacattctgatatgtagaaaatgcataaaaaccatcctaagattatacaggcaaaggaaatgtcacagaaagtataatctattattcactcagaccatttcttgtccctgggacaaagattctgaagaacaacctccagaggctaagaaggcaggattgactggagtgtg

SEQ ID NO: 77688 - DNA, 601 bp, Human
cctttgtgttatctttggttccccttagccatctgccacctattgtggtagggaggagagcctcgtagctcgtgaccctgccgtgcgggccttcaagttgggaggtgaagagataagcagcccgctcgctggctggggagagacctctctcccagctgtttctagctggttactgtcagttttgggaagcgatagccatctcggaacgcacccacacagaccctgccttctgaggaaaacagatgtttcatcaaaacaacccagttttcactcccttaggcactgctaaggaaggttctcygactcttctgaaggaagcagagggaacacagggtgggaggtccagtgacttgctgtggacccaacaatgttggcagccttcctggccctgaaacttcagctcacaggtctccagaggccctgcctggacatgccagtcccagtcacacccttcccttgctttgggggtgtgccaaaagcaatacactggccactagagagtaccctagagctctagaatcccctcccaacacgcacacacacacacacacacacacactctctctctcacacacacacactcagtacacacacacacaca

SEQ ID NO: 77689 - DNA, 601 bp, Human
taaggaaggttctccgactcttctgaaggaagcagagggaacacagggtgggaggtccagtgacttgctgtggacccaacaatgttggcagccttcctggccctgaaacttcagctcacaggtctccagaggccctgcctggacatgccagtcccagtcacacccttcccttgctttgggggtgtgccaaaagcaatacactggccactagagagtaccctagagctctagaatcccctcccaacacgcacacacacacacacacacacacactctctctctcacacacacacactcagtacacacacacacacacacacacacactctctcacatacacttgtcctggaagcaggaaagtggatctttccagcttccataaaattttctctgctaagtggaaagagggtcctagaactcagaggaatccacctcccttacttaaagggcccctttctctcctcctgtcccttgaccctccaccccgccctatggtagtatccatggcctagctgctctaaccagggcatctgcccctggtcctgtctccacagagcactacaaacaccactggtttcccgaaaagccgtccaagggctcc

SEQ ID NO: 77690 - DNA, 601 bp, Human; identical to SEQ ID NO: 35215

SEQ ID NO: 77691 - DNA, 601 bp, Human; identical to SEQ ID NO: 35216

SEQ ID NO: 77692 - DNA, 601 bp, Human; identical to SEQ ID NO: 29874

SEQ ID NO: 77693 - DNA, 601 bp, Human; identical to SEQ ID NO: 28699

SEQ ID NO: 77694 - DNA, 601 bp, Human; identical to SEQ ID NO: 28700

SEQ ID NO: 77695 - DNA, 601 bp, Human; identical to SEQ ID NO: 28701

SEQ ID NO: 77696 - DNA, 601 bp, Human; identical to SEQ ID NO: 28702

SEQ ID NO: 77697 - DNA, 601 bp, Human; identical to SEQ ID NO: 28703

SEQ ID NO: 77698 - DNA, 601 bp, Human; identical to SEQ ID NO: 28704

SEQ ID NO: 77699 - DNA, 601 bp, Human; identical to SEQ ID NO: 28705

SEQ ID NO: 77700 - DNA, 601 bp, Human; identical to SEQ ID NO: 28706

SEQ ID NO: 77701 - DNA, 601 bp, Human; identical to SEQ ID NO: 28707

SEQ ID NO: 77702 - DNA, 601 bp, Human; identical to SEQ ID NO: 28708

SEQ ID NO: 77703 - DNA, 601 bp, Human; identical to SEQ ID NO: 28709

SEQ ID NO: 77704 - DNA, 601 bp, Human; identical to SEQ ID NO: 28710

SEQ ID NO: 77705 - DNA, 601 bp, Human; identical to SEQ ID NO: 28711

SEQ ID NO: 77706 - DNA, 601 bp, Human; identical to SEQ ID NO: 28712

SEQ ID NO: 77707 - DNA, 601 bp, Human; identical to SEQ ID NO: 28713

SEQ ID NO: 77708 - DNA, 601 bp, Human; identical to SEQ ID NO: 28714

SEQ ID NO: 77709 - DNA, 601 bp, Human; identical to SEQ ID NO: 28715

SEQ ID NO: 77710 - DNA, 601 bp, Human; identical to SEQ ID NO: 28716

SEQ ID NO: 77711 - DNA, 601 bp, Human; identical to SEQ ID NO: 28717

SEQ ID NO: 77712 - DNA, 601 bp, Human; identical to SEQ ID NO: 28718

SEQ ID NO: 77713 - DNA, 601 bp, Human; identical to SEQ ID NO: 28719

SEQ ID NO: 77714 - DNA, 601 bp, Human; identical to SEQ ID NO: 28720

SEQ ID NO: 77715 - DNA, 601 bp, Human; identical to SEQ ID NO: 28721

SEQ ID NO: 77716 - DNA, 601 bp, Human; identical to SEQ ID NO: 28722

SEQ ID NO: 77717 - DNA, 601 bp, Human; identical to SEQ ID NO: 28723

SEQ ID NO: 77718 - DNA, 601 bp, Human; identical to SEQ ID NO: 28724

SEQ ID NO: 77719 - DNA, 601 bp, Human; identical to SEQ ID NO: 28725

SEQ ID NO: 77720 - DNA, 601 bp, Human; identical to SEQ ID NO: 28726

SEQ ID NO: 77721 - DNA, 601 bp, Human; identical to SEQ ID NO: 28727

SEQ ID NO: 77722 - DNA, 601 bp, Human; identical to SEQ ID NO: 28728

SEQ ID NO: 77723 - DNA, 601 bp, Human; identical to SEQ ID NO: 28729

SEQ ID NO: 77724 - DNA, 601 bp, Human; identical to SEQ ID NO: 28730

SEQ ID NO: 77725 - DNA, 601 bp, Human; identical to SEQ ID NO: 28731

SEQ ID NO: 77726 - DNA, 601 bp, Human; identical to SEQ ID NO: 28732

SEQ ID NO: 77727 - DNA, 601 bp, Human; identical to SEQ ID NO: 28733

SEQ ID NO: 77728 - DNA, 601 bp, Human; identical to SEQ ID NO: 28734

SEQ ID NO: 77729 - DNA, 601 bp, Human; identical to SEQ ID NO: 28735

SEQ ID NO: 77730 - DNA, 601 bp, Human; identical to SEQ ID NO: 28736

SEQ ID NO: 77731 - DNA, 601 bp, Human; identical to SEQ ID NO: 28737

SEQ ID NO: 77732 - DNA, 601 bp, Human; identical to SEQ ID NO: 28738

SEQ ID NO: 77733 - DNA, 601 bp, Human; identical to SEQ ID NO: 28739

SEQ ID NO: 77734 - DNA, 601 bp, Human; identical to SEQ ID NO: 28740

SEQ ID NO: 77735 - DNA, 601 bp, Human; identical to SEQ ID NO: 28741

SEQ ID NO: 77736 - DNA, 601 bp, Human; identical to SEQ ID NO: 28742

SEQ ID NO: 77737 - DNA, 601 bp, Human; identical to SEQ ID NO: 28743

SEQ ID NO: 77738 - DNA, 601 bp, Human; identical to SEQ ID NO: 28744

SEQ ID NO: 77739 - DNA, 601 bp, Human; identical to SEQ ID NO: 28745

SEQ ID NO: 77740 - DNA, 601 bp, Human; identical to SEQ ID NO: 28746

SEQ ID NO: 77741 - DNA, 601 bp, Human; identical to SEQ ID NO: 28747

SEQ ID NO: 77742 - DNA, 601 bp, Human; identical to SEQ ID NO: 28748

SEQ ID NO: 77743 - DNA, 601 bp, Human; identical to SEQ ID NO: 28749

SEQ ID NO: 77744 - DNA, 601 bp, Human; identical to SEQ ID NO: 28750

SEQ ID NO: 77745 - DNA, 601 bp, Human; identical to SEQ ID NO: 28751

SEQ ID NO: 77746 - DNA, 601 bp, Human; identical to SEQ ID NO: 28752

SEQ ID NO: 77747 - DNA, 601 bp, Human; identical to SEQ ID NO: 28753

SEQ ID NO: 77748 - DNA, 601 bp, Human; identical to SEQ ID NO: 28754

SEQ ID NO: 77749 - DNA, 601 bp, Human; identical to SEQ ID NO: 28755

SEQ ID NO: 77750 - DNA, 601 bp, Human; identical to SEQ ID NO: 28756

SEQ ID NO: 77751 - DNA, 601 bp, Human; identical to SEQ ID NO: 28757

SEQ ID NO: 77752 - DNA, 601 bp, Human; identical to SEQ ID NO: 28758

SEQ ID NO: 77753 - DNA, 601 bp, Human; identical to SEQ ID NO: 28759

SEQ ID NO: 77754 - DNA, 601 bp, Human; identical to SEQ ID NO: 28760

SEQ ID NO: 77755 - DNA, 601 bp, Human; identical to SEQ ID NO: 28761

SEQ ID NO: 77756 - DNA, 601 bp, Human; identical to SEQ ID NO: 28762

SEQ ID NO: 77757 - DNA, 601 bp, Human; identical to SEQ ID NO: 28763

SEQ ID NO: 77758 - DNA, 601 bp, Human; identical to SEQ ID NO: 28764

SEQ ID NO: 77759 - DNA, 601 bp, Human; identical to SEQ ID NO: 28765

SEQ ID NO: 77760 - DNA, 601 bp, Human; identical to SEQ ID NO: 28766

SEQ ID NO: 77761 - DNA, 601 bp, Human; identical to SEQ ID NO: 28767

SEQ ID NO: 77762 - DNA, 601 bp, Human; identical to SEQ ID NO: 28768

SEQ ID NO: 77763 - DNA, 601 bp, Human; identical to SEQ ID NO: 28769

SEQ ID NO: 77764 - DNA, 601 bp, Human; identical to SEQ ID NO: 28770

SEQ ID NO: 77765 - DNA, 601 bp, Human; identical to SEQ ID NO: 28771

SEQ ID NO: 77766 - DNA, 601 bp, Human; identical to SEQ ID NO: 28772

SEQ ID NO: 77767 - DNA, 601 bp, Human; identical to SEQ ID NO: 28773

SEQ ID NO: 77768 - DNA, 601 bp, Human; identical to SEQ ID NO: 28774

SEQ ID NO: 77769 - DNA, 601 bp, Human; identical to SEQ ID NO: 28775

SEQ ID NO: 77770 - DNA, 601 bp, Human; identical to SEQ ID NO: 28776

SEQ ID NO: 77771 - DNA, 601 bp, Human; identical to SEQ ID NO: 28777

SEQ ID NO: 77772 - DNA, 601 bp, Human; identical to SEQ ID NO: 28778

SEQ ID NO: 77773 - DNA, 601 bp, Human; identical to SEQ ID NO: 28779

SEQ ID NO: 77774 - DNA, 601 bp, Human; identical to SEQ ID NO: 28780

SEQ ID NO: 77775 - DNA, 601 bp, Human; identical to SEQ ID NO: 28781

SEQ ID NO: 77776 - DNA, 601 bp, Human; identical to SEQ ID NO: 28782

SEQ ID NO: 77777 - DNA, 601 bp, Human; identical to SEQ ID NO: 28783

SEQ ID NO: 77778 - DNA, 601 bp, Human; identical to SEQ ID NO: 28784

SEQ ID NO: 77779 - DNA, 601 bp, Human; identical to SEQ ID NO: 28785

SEQ ID NO: 77780 - DNA, 601 bp, Human; identical to SEQ ID NO: 28786

SEQ ID NO: 77781 - DNA, 601 bp, Human; identical to SEQ ID NO: 38568

SEQ ID NO: 77782 - DNA, 601 bp, Human; identical to SEQ ID NO: 38569

SEQ ID NO: 77783 - DNA, 601 bp, Human; identical to SEQ ID NO: 38570

SEQ ID NO: 77784 - DNA, 601 bp, Human; identical to SEQ ID NO: 38571

SEQ ID NO: 77785 - DNA, 601 bp, Human; identical to SEQ ID NO: 38572

SEQ ID NO: 77786 - DNA, 601 bp, Human; identical to SEQ ID NO: 38573

SEQ ID NO: 77787 - DNA, 601 bp, Human; identical to SEQ ID NO: 38574

SEQ ID NO: 77788 - DNA, 601 bp, Human; identical to SEQ ID NO: 38575

SEQ ID NO: 77789 - DNA, 601 bp, Human; identical to SEQ ID NO: 38576

SEQ ID NO: 77790 - DNA, 601 bp, Human; identical to SEQ ID NO: 38577

SEQ ID NO: 77791 - DNA, 601 bp, Human; identical to SEQ ID NO: 38578

SEQ ID NO: 77792 - DNA, 601 bp, Human; identical to SEQ ID NO: 38579

SEQ ID NO: 77793 - DNA, 601 bp, Human; identical to SEQ ID NO: 38580

SEQ ID NO: 77794 - DNA, 601 bp, Human; identical to SEQ ID NO: 38581

SEQ ID NO: 77795 - DNA, 601 bp, Human; identical to SEQ ID NO: 38582

SEQ ID NO: 77796 - DNA, 601 bp, Human; identical to SEQ ID NO: 38583

SEQ ID NO: 77797 - DNA, 601 bp, Human; identical to SEQ ID NO: 38584

SEQ ID NO: 77798 - DNA, 601 bp, Human; identical to SEQ ID NO: 38585

SEQ ID NO: 77799 - DNA, 601 bp, Human; identical to SEQ ID NO: 38586

SEQ ID NO: 77800 - DNA, 601 bp, Human; identical to SEQ ID NO: 38587

SEQ ID NO: 77801 - DNA, 601 bp, Human; identical to SEQ ID NO: 38588

SEQ ID NO: 77802 - DNA, 601 bp, Human
aaaatgaaaataagagtgcagcaagcaggagccttagccaccgaagccgtaaagagtgcgtccctgtcgcttcagcgcgtagaccacatccattgctgtcacggtcttgcgtttggcgtgctctgtgtaagtgacagcgtcacgaatcacgttctccaggaacaccttcagaacaccacgagtctcctcatagataaggccagaaattcgcttgacaccgccgcgacgagcaaggcgccggatagctggcttagtgatgccctggatgttatcgcgcaaaaccttgcgatgacgcttagcycctcccttacccaaaccttttccacctttaccacggccagacatgactaagcaacttctaaaaccaacttaagaaacctaaacgccaaggcaaagcaacgcccttatatgccgggaattcggacctaattgaagactgaaagcgcgcataccggaactttggtcctgcttcttggccccaccccgcatagcccagccctggatgacgtcaccaacgactccagcctttggcatctgagcgccggctccgcggaggcgtctcttgcaattgctgggaaataggaatgagagttttaaggct

SEQ ID NO: 77803 - DNA, 601 bp, Human
acctgcaaatctacacatgtgcacagtaactacttctcagcaaaaatctggaacaaagcaggataacaagatgtctgctcttttatgaaaaaagtgggcggccctgaaaagggcctttggttgaaaatgaaaataagagtgcagcaagcaggagccttagccaccgaagccgtaaagagtgcgtccctgtcgcttcagcgcgtagaccacatccattgctgtcacggtcttgcgtttggcgtgctctgtgtaagtgacagcgtcacgaatcacgttctccaggaacaccttcagaacaccrcgagtctcctcatagataaggccagaaattcgcttgacaccgccgcgacgagcaaggcgccggatagctggcttagtgatgccctggatgttatcgcgcaaaaccttgcgatgacgcttagctcctcccttacccaaaccttttccacctttaccacggccagacatgactaagcaacttctaaaaccaacttaagaaacctaaacgccaaggcaaagcaacgcccttatatgccgggaattcggacctaattgaagactgaaagcgcgcataccggaactttggtcctgcttcttggcc

SEQ ID NO: 77804 - DNA, 601 bp, Human
ttccatttactacagaatttataaaattccaattattccttattgtaaaatgatttatagcctctaaaacagtattctatgcctctcatctttgagttggagcctctcccatacccatgtggagagacaaaaggattattctaagtgcagaattagcaggtgagagctggtatgcataatttgagttgttgttagagaaggaaaaatgaagggagggggttgggagagaaagacaggatattaaataatttaaaatagcaagattgtgaggaaggaaaaaatgcagaatatttaaataaamaattaacaaaattttagaagcattaaatgataaaatatagtaaaatgacaaaaatgtgggagaagagcaggtaggtaaaagaaccaaaatgtaagattagaaagtaaaaagagaaaagtgaagcatctcctggactcaccctgaagttctcaggatccacgtgcagcttgtcacagtgcagctcactcagctgagaaaaagtgcccttgaggttgtccaggtgagccaggccatcactaaaggcacctagcaccttcttgccatgagccttcaccttagggttgcccataacagcatcag

SEQ ID NO: 77805 - DNA, 601 bp, Human
aacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggtaagggccttcaccttcgcctagatgacggcccctcaaagctgcggggctgcagggcgtggatcccagacaccttcccctttgtgaccctcagagggccggctgtgggcccagcgggactggcggaagccgggtcctagcctcggccctactcccataagctttgccgctcgttctggcgcccgaagaaattttgatactgcttcccctccccacaaaaagtaaaac

SEQ ID NO: 77806 - DNA, 601 bp, Human
attcaaatactactttttttgctgggtgcagtggttcatgcctgtaatcccagcactttgggaggccaaggtgggcagatcacctgaggtcaggagttcaagaccagcctggccaacatggtgaaacgtcgtctctactaaaaatacaaaaatgagccaggcgggatggcacgtgcctgtaatctcagctaccccagaggctgaggcaggagaattgcttgaacccaggagacggaggctgcagtaagctgagatggtgccattgcactccagcctgggcaacagtgagactctgtctcamcaaaaaaaaaaaaaaaaaaggaagaaagaaagaaagtactccttttttcaagtacatatttgtgtgaggccagattttcttcatgtacttaaactaaacggtattgtaatagatggagtgcagaagcagataagagaatccagctatcttctgttaagccagtcattaaagagacagttgcaaatatgtaaaacattgcttacacttatcaccaacttggggagaaatataattttaatttatattctgtgtaatgggtttgcagtttaacctaccttttttttttggagacagagtctt

SEQ ID NO: 77807 - DNA, 601 bp, Human
ggcgcacacctgtagtctcagctacttatggaggctgaggtgagaggatcacttgagcccaggaggtcaaggctgcagtgagccatgactgtgccactgcactctagcctgggcaacagagcaagattctatctcaaaagtacaattttgcatatacaaagttggagtcaatgaccacacacagtggttcatgcctattaattccagcactttggaaggctgaggagggtggattgcttgagcccaggagttcaagaccagcttaggcaacatggtgaaaccctgtctctacaaaaaatasaaaaattagctgggcacagtggtgcgtacctgtattcccagctactagggaggccgaggtgggagaattgctggagcctgggaggttgaggctgtagcaagccatgattgtgccaccgctctccatcctgggtgacaaagcaagaccctatctcaaaaaaaaaaaagaaaattgggatgttatatataaaataaggtgttttttttggtttgtttgtttttgtttttttaatatactgtgaacattttccttaataaatattctgggctgagtgcagtggctcacgcctgtaatcctagc

SEQ ID NO: 77808 - DNA, 601 bp, Human
gtgtgagccaccgtgcccggcctcaaaataaatcttttcagatactaattattattttgattgagttttttgtttgtttttttaattgctgcataacaactagactaagttttttaaacgtggggattactgggtcagaggcttgtgtgtttttaaagcttttaatgtcattttccatttttttccttcagtggaattgttctcattttcacttcatagagtagtttgttactattcttcactaaacgatggctaattcctttgtaataaatttggtcttccttgacatcttgctgtttayatctattacatttatatttctgtattataaattaccatgtgaaagacttctccaaattcttgaagctcctcttcagtctcacagcctttgctcatttaaatgtggcgttccccatcagccaactcactttcaggaagaacattttcagaggtcctcttggtcgtgtctctagtactgcagaatacattatagagctccctacccagaggagagatgtgtttcgtttgtgtctggaatcaaggtgactttccagtaatagatactacctttggcacttcatttctgtgaagttgctttttc

SEQ ID NO: 77809 - DNA, 601 bp, Human
gcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcaggtaagtgtgtgttaggatgtattataatttgtcagtattctgtakgatatagtcagctccttagcacacaggtaaccaatggcagagcttggacaagaatccatgcttttcagctaacttttctctttcagtagtgcctacttgggatccagtctgcagtccctttcctgattgtgtaagttacatgttctcacaggtcaaacctaatttgtgtccatgaagcatagccaagggttgtggaaaagaaaaaatggcttggaaaaaccataggaacctaaagaaactgccaagtgtagataagcattgagtatgttaccccatccaagaaattctattttaaaaaaa

SEQ ID NO: 77810 - DNA, 601 bp, Human
cttaccttgctgctgatggcttctggtgtgggcacagttccaggctctggacagtcaccccctccaggaagtcctccttactgccctctcccagttatcagaaagactgctggtcccagagtgggtaacagctgagtagaaggacaggcaggactggtgcaggctcctgaaggctcaggagaacagagggatggaggaagggggctgctgtaggggagaggagcggcccagcttcgcctcactccccaagcatccttcgggaggagcagagccgccagaggggccgccctgggtctggctrtctgcgttgggcagggcgagcacaggctgctgctgggcagcagggctgaggggccggctctctcctcctccttgttgatctcctctctggctccaagttgctcacagagcgatcctgggtcccagatagggcgggcagtcactgctggctgctggcagcctcaggagctcacaccactatgggcttccatgcccccccacttcccccgccactttgggggaaaggctgcagggtggcttctgattggcccagctgggagaagggggggcggcggggcagggagggtggacgcgtgcgtct

SEQ ID NO: 77811 - DNA, 601 bp, Human
gcaggatggtgcgcattccttctgggaattttgggatctgactggcgggaacaaaaggcccaagtttggagtaatggggcacggggagattccaacctctccaggctgtgccacttactagctgtgtggctacagttaggtggctgcgtgagcctcaatttcctcatgtataaaacggaggtaaaaacagtcactgcctctggggttgctggtgagcattacatgagatcagtctcataaagcactcagcacagttgcggcgtgcagtaagtgtcaagcagtggcagcctctgttaggagytgggactttctccaggcactggggagccataggcggatcctgggcagggaggtggtgtgattggatttatgctttagaatggcatggagaaggggtagagtccagaaggagggagacaacgaggaggcctgagcagctgcctgggaccaaaggaaatggcccagtggctgaccccttcttcacagaggagcccccagatctgacagccaggtcccagcccccagacccagcagcatgaccgctagggggttgccatggccgcccatcaccctcgaactttcctagccctcaaacttttct

SEQ ID NO: 77812 - DNA, 601 bp, Human
caaagtgcatggctagcacttggaagacaggaagaacctaggaaggctgcctggaagaggtggtgtatggaatatccctgaaagaaaagtgatgaggaagggcattccagaaagggggaagagggagggcaaatgcccacaagcaggatggtgcgcattccttctgggaattttgggatctgactggcgggaacaaaaggcccaagtttggagtaatggggcacggggagattccaacctctccaggctgtgccacttactagctgtgtggctacagttaggtggctgcgtgagcctcaakttcctcatgtataaaacggaggtaaaaacagtcactgcctctggggttgctggtgagcattacatgagatcagtctcataaagcactcagcacagttgcggcgtgcagtaagtgtcaagcagtggcagcctctgttaggagctgggactttctccaggcactggggagccataggcggatcctgggcagggaggtggtgtgattggatttatgctttagaatggcatggagaaggggtagagtccagaaggagggagacaacgaggaggcctgagcagctgcctgggaccaaaggaaatg

SEQ ID NO: 77813 - DNA, 601 bp, Human
caagtaacatggcttcagcacaaagtgcatggctagcacttggaagacaggaagaacctaggaaggctgcctggaagaggtggtgtatggaatatccctgaaagaaaagtgatgaggaagggcattccagaaagggggaagagggagggcaaatgcccacaagcaggatggtgcgcattccttctgggaattttgggatctgactggcgggaacaaaaggcccaagtttggagtaatggggcacggggagattccaacctctccaggctgtgccacttactagctgtgtggctacagttakgtggctgcgtgagcctcaatttcctcatgtataaaacggaggtaaaaacagtcactgcctctggggttgctggtgagcattacatgagatcagtctcataaagcactcagcacagttgcggcgtgcagtaagtgtcaagcagtggcagcctctgttaggagctgggactttctccaggcactggggagccataggcggatcctgggcagggaggtggtgtgattggatttatgctttagaatggcatggagaaggggtagagtccagaaggagggagacaacgaggaggcctgagcagct

SEQ ID NO: 77814 - DNA, 601 bp, Human
ccttaaacctttccccagcagaaagtgcggcctcagttctgactgctggggcctgaacaatctctgatgaacaaacagaacataaacagatcaccaacaggggagggccaagtaacatggcttcagcacaaagtgcatggctagcacttggaagacaggaagaacctaggaaggctgcctggaagaggtggtgtatggaatatccctgaaagaaaagtgatgaggaagggcattccagaaagggggaagagggagggcaaatgcccacaagcaggatggtgcgcattccttctgggaattytgggatctgactggcgggaacaaaaggcccaagtttggagtaatggggcacggggagattccaacctctccaggctgtgccacttactagctgtgtggctacagttaggtggctgcgtgagcctcaatttcctcatgtataaaacggaggtaaaaacagtcactgcctctggggttgctggtgagcattacatgagatcagtctcataaagcactcagcacagttgcggcgtgcagtaagtgtcaagcagtggcagcctctgttaggagctgggactttctccaggcactggggagccat

SEQ ID NO: 77815 - DNA, 601 bp, Human
atgtcctgaatgcccagcatgttccaagtgctgaggaatacagcagcaactttgaggtaacagatgtaaagcacaattgaagtagacacagaaagtgctaagaacgagttggttcctgttatatcatcatgctcacactgcttcccagctgaggtgctacaagccctgaccctgggaaggggcccaacaccccttcccttccctcctaacgctctgggtcagaagacagggggcaccaaaaagattcccattccaagaacccactgcccactgggttctgaatcaaatgcaagaaatgggygggcatttcagaagaccttttcatccctttctcccttcccactgcattcagcagcagcctgttctgagccaatgcccagagcaccctcctttagcctagaaggcagctggtctcagagtcagactgtggcctgtgcctggaggatggacacggatctttggaacatacatggtgtccaggtcccttctgtgggcagagccttttgcaggttgcagattaatttcacagccaagtgttccaatgcaggaggccaggagagcagtggttctctcagccagtggccagaggtccagctgtgaa

SEQ ID NO: 77816 - DNA, 601 bp, Human
gtcgcttaggctcactgcaatctccgcctcctggattcaagcaattctagtgcctcagcctcctgagtagctgggatacaggtgcgcaccaccacgtctggctaatttttgtatttttagtagagacagggtttcaccatgttggccaggctggtctcaaactccagacctcgggtgatccacccgcctcggcctcccaaagtgctgggataacatgtgtgagccaccgtgcccagcctcgatggttaaattaatccagtaaatatttattaagaatgtcctgaatgcccagcatgttccragtgctgaggaatacagcagcaactttgaggtaacagatgtaaagcacaattgaagtagacacagaaagtgctaagaacgagttggttcctgttatatcatcatgctcacactgcttcccagctgaggtgctacaagccctgaccctgggaaggggcccaacaccccttcccttccctcctaacgctctgggtcagaagacagggggcaccaaaaagattcccattccaagaacccactgcccactgggttctgaatcaaatgcaagaaatgggcgggcatttcagaagaccttttcatc

SEQ ID NO: 77817 - DNA, 601 bp, Human
ttatttattttttttgagacagtcttgccctgtcgcttaggctcactgcaatctccgcctcctggattcaagcaattctagtgcctcagcctcctgagtagctgggatacaggtgcgcaccaccacgtctggctaatttttgtatttttagtagagacagggtttcaccatgttggccaggctggtctcaaactccagacctcgggtgatccacccgcctcggcctcccaaagtgctgggataacatgtgtgagccaccgtgcccagcctcgatggttaaattaatccagtaaatatttaytaagaatgtcctgaatgcccagcatgttccaagtgctgaggaatacagcagcaactttgaggtaacagatgtaaagcacaattgaagtagacacagaaagtgctaagaacgagttggttcctgttatatcatcatgctcacactgcttcccagctgaggtgctacaagccctgaccctgggaaggggcccaacaccccttcccttccctcctaacgctctgggtcagaagacagggggcaccaaaaagattcccattccaagaacccactgcccactgggttctgaatcaaatgcaagaa

SEQ ID NO: 77818 - DNA, 601 bp, Human
ggaagaaagatttaccatcatctgggtcaacctcctcgtttgactgatgggaaaactgaggccccagaagggaacgatctgtgcacagtcccatagggttctagggtctgatgactacctctggaatgctgagggcccccacagctgaggcacattctcagggtttacactggatccccaggggcatcccaggccccatccagcctctcatcaaggggatctggagtcagaaacacccaggtgcaaatcccagctccgccacttccgagctgtgggactttaggcaactgactctgcgcaytttctcacctgtaaaatggggagagtttagctgggtgcggtggctcacgcctgtaatcccagcactttgggagtctgaggcaggcggatcacttgaggtcaggtagttcgagaccagcctggccaacacggtgaaaccccatctgtactaaaaatataaaaattagctgggcatggtggcgcacacgcctgtaatcccagctacttgggaggctgaggcaggagaatcacttgagcttgggaagcggaggttgcggtgagccaagatcataccattgcactccagcctgggcaacagagt

SEQ ID NO: 77819 - DNA, 601 bp, Human
gacctggaggctgagccctgaaccacagaggtggagctgggtctctccaggccttcagagagatggtaaagacccagcacctgtggtggaacaaaggcgagcccaggtcccaggctcagcgtcatcaccaatgatctgtacggaccttaggtgcaacccttcccctctctggaccttagttcccatccatacaataaagcagttggatcaggtgacccccaaaagtccttttcatctctgacattcaggaactttcagaccccctgaccctcccaagggacagccctctccatcacagggyggagaagctggtacctctggcagataaaaggtttcaggcacctgagacatcaaatagccctgatctgaattgaggagaggaggggattttaatgcggttaaagcagtacactttgattttcagcctcctgcaccaggctgggggtgggctaccccaggaagcatctggtggatgtagggggcgggggcagggtgggctctggggctaaggcttggaggttcaggaagactttatcctgaggatctgggcctgagggctcaggagggatgtgaagtgggcttccacactggaagcaacaag

SEQ ID NO: 77820 - DNA, 601 bp, Human
ttccttccagggaggtgatggagatgagctggtgagggcagaacagacatatggcactctgaagccaacaggctgcgcctgatgccatccagggcagggatgggagccccgccaggctgggagcagtggttccagctggaagccacttattcctgggtccaagccccagttctctgagtttaacttatctgagtcccaatttcctgggaaatggcatgggagacctccttttccatttctgggagggccagagatgatgacgcacagcacttggcacatcataggtgcccagtaaatggtractaacaacagtatatgattactccagtggggagagcgggtatggcttcctgagggaggtggccttgagctaggcctccagggtttcttgagttttttggcagatgatgccagggaaaggtatggccagggctctgtgagagatgaaaggcatctgggagaaatggcagggagagatctgttgggctagaaactggggctcttcagcaaacaggtaggtgatggcctgggaaggaggcagcaggaggccagggaaggaggcagggagacttcaggaaaggtctgcggtgctgtgtgagga

SEQ ID NO: 77821 - DNA, 601 bp, Human
gcaaagtgatgcatgtgataaatgagacggtgcaagaaggcctctcccaaaagacgctcctcaggaagaggtagctgctgattattggtacaatcagtagcaacagcccttttcagtgtcctgaggctcagtgaggagtgtctcatcctagcacactcggcgattcggtggccaacctaaggccagacccatctaatcaccactgtctgtcaattacttctttcctgaacttttgtcttagtcctttaatatgacttcccacaaatcaggatacctacctaacaacgatctggactctctycaacttcctaatatggaattaggcctacagtaggtgctcagtaaacgcttacacgatatgagagattaaatggctctgtagggtcagctcttcagtcctgggccctcggctgcctcctaataacacaggattcactaggctagggaactggcatggataggcaatggtgactctttccttccagggaggtgatggagatgagctggtgagggcagaacagacatatggcactctgaagccaacaggctgcgcctgatgccatccagggcagggatgggagccccgccaggctgggagcag

SEQ ID NO: 77822 - DNA, 601 bp, Human
ggctggctattagcagttaagtttttggggagtcaaaagctatacatgaattttcaactttgcagttggtggctgtccccagccccctcattgttcaagggtctgctgtacttatcacccactatctatgctaagctccttatatgaatgatctcaccaagtcctcagaacaatcccatgacatcagtactgcttcctcattttacagatgtggaaactgaggcacagactgtttacattgtttgcccaaaagcttgccagtggtgtctccagtgtttaacactgggcagacaggctccaragcacacagcccaatgcccatgagacagcccctctgtggcaggaggcaaagataaggagccccgcaaaaaggacagcccagtacctggcacagaacaagctcaaataaaaaaaaataaaagttaattagccaggcgtggtggagggagcctgtaatcccagcttctcgggaggctgagtcaggagaattgcttgaacccgagatcgcgccactgcactccagcctgggcaacaagagtgaaactccgtctcaaaaaaataaattaaaaaataaagtcgtcagccttatcttttcgccttc

SEQ ID NO: 77823 - DNA, 601 bp, Human
tatcagtaaggcccacagtaggctggctattagcagttaagtttttggggagtcaaaagctatacatgaattttcaactttgcagttggtggctgtccccagccccctcattgttcaagggtctgctgtacttatcacccactatctatgctaagctccttatatgaatgatctcaccaagtcctcagaacaatcccatgacatcagtactgcttcctcattttacagatgtggaaactgaggcacagactgtttacattgtttgcccaaaagcttgccagtggtgtctccagtgtttaayactgggcagacaggctccagagcacacagcccaatgcccatgagacagcccctctgtggcaggaggcaaagataaggagccccgcaaaaaggacagcccagtacctggcacagaacaagctcaaataaaaaaaaataaaagttaattagccaggcgtggtggagggagcctgtaatcccagcttctcgggaggctgagtcaggagaattgcttgaacccgagatcgcgccactgcactccagcctgggcaacaagagtgaaactccgtctcaaaaaaataaattaaaaaataaagtcgtc

SEQ ID NO: 77824 - DNA, 601 bp, Human
gcctttcagaatcttccggcccggccctgacagctccctcacaactgagggaggaaggcggctgcccctccagctccccagggcccaagccaggccctcacactcgtcactcactgcatgctcctctccccatgaggcctccccagggaacacaatggaaagaaatgacctattttctggaagtccaaaataagatgaaacatctgtctggaatggggccaggctgataaagaacgggctgatctccccagcccgagccccgctctcctgcagcaaacaccccctcacccgtcagagtgcstgtgcttgggggtgggggcagcgatgcggctggctacttggaacagtgcgtgggaaagcgctcagtgtgtgcctcacggctgctgggggcccaagggagggggcctgggtccccaggaaggctgggaagcagcctgagaaggaggtcagtgagggagggaggcctgctgcacacccctgcccaccggctgcagagcaagcacttcctgcctcctgcggtgccttgagggttacccccagggccctgtggattcctggccctgagtccccccacccaccccggccccatctgggcctccaa

SEQ ID NO: 77825 - DNA, 601 bp, Human
tatgtgacctctccggccctcctctgctctccatccccctcaggcaaaggctggcttctctgcccagcctttcagaatcttccggcccggccctgacagctccctcacaactgagggaggaaggcggctgcccctccagctccccagggcccaagccaggccctcacactcgtcactcactgcatgctcctctccccatgaggcctccccagggaacacaatggaaagaaatgacctattttctggaagtccaaaataagatgaaacatctgtctggaatggggccaggctgataaagaaygggctgatctccccagcccgagccccgctctcctgcagcaaacaccccctcacccgtcagagtgcgtgtgcttgggggtgggggcagcgatgcggctggctacttggaacagtgcgtgggaaagcgctcagtgtgtgcctcacggctgctgggggcccaagggagggggcctgggtccccaggaaggctgggaagcagcctgagaaggaggtcagtgagggagggaggcctgctgcacacccctgcccaccggctgcagagcaagcacttcctgcctcctgcggtgccttgagggttacc

SEQ ID NO: 77826 - DNA, 601 bp, Human
ccggcgcagcccactcggtgttggagccattctctgtgccacgctgcttctaggcccggggtcctctttatgtttctccaggtacctacaaagtcccctgaacaaagcagcagaaatcgactaagatggggcctggcgtgtgctcccgctgctctggaagtccaaactggatggaagaatagcgctggttccctggaaggctgctaagccccctgcaccccctcctccagcacaggctcggctgcctctggctatcccaccgccaatctcctcacctccaatctgtcccctccacctgttytcacaccccagccagagggacctttctgaaatacctatgtgacctctccggccctcctctgctctccatccccctcaggcaaaggctggcttctctgcccagcctttcagaatcttccggcccggccctgacagctccctcacaactgagggaggaaggcggctgcccctccagctccccagggcccaagccaggccctcacactcgtcactcactgcatgctcctctccccatgaggcctccccagggaacacaatggaaagaaatgacctattttctggaagtccaaaataagatgaa

SEQ ID NO: 77827 - DNA, 601 bp, Human
aaaggaagcagagtggggaccccaagtcaaaggagcagagtaaggaccccaagtccaggggagaggagtgggtgccccaagtccaggagagcaagcatgcttggggagtcattctcagagccccagacttccctcctcccagcacgtacaattctccactcctttcccaccgccttaatctaaataaatccagcccatcttggccacatccgccagcaacagcttccctccctcagggtcctgaggctcccacgacacaggcaggccagggagggggccctgcattgctgcgggggttgayggggggagcctgcacatggtcagcacatacacacagcacagatgcacagatgcctgcctacgcacttcctcgcacactcctctgaaacacatacgtatgcaagaggccatgtgggtgccaagccctcatgcaggtactaaacatgtacacacccacacaaaacacatgtgcgcagctcccactgtgcccagcacccgtggagatgcacccgtgtgcaacagttcacatgtgtatgcagcacatacaacatgcacagaacatgtgcacatagaaccccaaattcacctgaacacacagcca

SEQ ID NO: 77828 - DNA, 601 bp, Human
gagtgaggaccccaagtccggggcacagagtggaaccccaagttcaggggagaggagtggggggccccaagtctaggggagcggagtaaggaccccaagtccaggggagcagactgggaactccaagtcaaaaggaagcagagtggggaccccaagtcaaaggagcagagtaaggaccccaagtccaggggagaggagtgggtgccccaagtccaggagagcaagcatgcttggggagtcattctcagagccccagacttccctcctcccagcacgtacaattctccactcctttcccacygccttaatctaaataaatccagcccatcttggccacatccgccagcaacagcttccctccctcagggtcctgaggctcccacgacacaggcaggccagggagggggccctgcattgctgcgggggttgatggggggagcctgcacatggtcagcacatacacacagcacagatgcacagatgcctgcctacgcacttcctcgcacactcctctgaaacacatacgtatgcaagaggccatgtgggtgccaagccctcatgcaggtactaaacatgtacacacccacacaaaacacatgtg

SEQ ID NO: 77829 - DNA, 601 bp, Human
ctggatgtcacagtcagagagcaggcactccccctatctgctgtactctcctgcccagggaggcctctagagcagagagagggagggcacccctaggtgtcccccttttgcccatgaagagagtgctatgtgccaggaacccctcctgattcctcctattctggccaggttgtaggctcagaggcccaaagtggagatcatgcccagctcctcacgtgactcagagggaccccttaggggagcagagtgaggaccccaagtccggggcacagagtggaaccccaagttcaggggagaggaktggggggccccaagtctaggggagcggagtaaggaccccaagtccaggggagcagactgggaactccaagtcaaaaggaagcagagtggggaccccaagtcaaaggagcagagtaaggaccccaagtccaggggagaggagtgggtgccccaagtccaggagagcaagcatgcttggggagtcattctcagagccccagacttccctcctcccagcacgtacaattctccactcctttcccaccgccttaatctaaataaatccagcccatcttggccacatccgccagcaacagcttcc

SEQ ID NO: 77830 - DNA, 601 bp, Human
ttccagccaatcccagggaggcccaggcagctgacttggtggtagtgggcttgcctgtgacaacttcccctctttaggaggactgtactctagggaagggccacctaggacaagctggatgtcacagtcagagagcaggcactccccctatctgctgtactctcctgcccagggaggcctctagagcagagagagggagggcacccctaggtgtcccccttttgcccatgaagagagtgctatgtgccaggaacccctcctgattcctcctattctggccaggttgtaggctcagaggccyaaagtggagatcatgcccagctcctcacgtgactcagagggaccccttaggggagcagagtgaggaccccaagtccggggcacagagtggaaccccaagttcaggggagaggagtggggggccccaagtctaggggagcggagtaaggaccccaagtccaggggagcagactgggaactccaagtcaaaaggaagcagagtggggaccccaagtcaaaggagcagagtaaggaccccaagtccaggggagaggagtgggtgccccaagtccaggagagcaagcatgcttggggagtcatt

SEQ ID NO: 77831 - DNA, 601 bp, Human
acataagaatccaccagccatctcattccacgaaaggaatttccatgactattcagccacagacttgctgtgcgggctttgacaagttgtttccctctctgggcctcagtttccccatctatacaattaagagttagaccaaggctgggcatggtggctcatgcctgtaatcccagcactttgggaggccgagccaggcggatcacgaggttgagagatcgagaccaacctagccaacatggtgaaaccccgtctctactaaaaatacaaaaattagctggacatggtggcaagtgcctgyagtcccagctactcaggaggccgaggcaggagaatcgcttgaacccaggaggcggaggttgcagtgagctgagatcacgccactacactccagcctggtgacagagtgagactctgtctcaaaaaaaaaaaaaaaagttagacaacagtgtttcaacagtgtttcaggggactttccgctggtgacgtggaaccccaggaggtggcaaggaaagagtggtagggacaagaggctggagggccagggagggcagagaagggcttagggcacccagacatgacttcccaggccatcctggat

SEQ ID NO: 77832 - DNA, 601 bp, Human
aggttggcaggtgtcatctcaaagagctgtccctatggtgaagctctgcctttctgacaggccaaagagaagattctagtcaccacgaatcttaccggggtgttttgaggaggtgggggctagtaagcaggagggggctacattcctgaggctagagtcacataagaatccaccagccatctcattccacgaaaggaatttccatgactattcagccacagacttgctgtgcgggctttgacaagttgtttccctctctgggcctcagtttccccatctatacaattaagagttagaccacggctgggcatggtggctcatgcctgtaatcccagcactttgggaggccgagccaggcggatcacgaggttgagagatcgagaccaacctagccaacatggtgaaaccccgtctctactaaaaatacaaaaattagctggacatggtggcaagtgcctgcagtcccagctactcaggaggccgaggcaggagaatcgcttgaacccaggaggcggaggttgcagtgagctgagatcacgccactacactccagcctggtgacagagtgagactctgtctcaaaaaaaaaaaaaaaagttag

SEQ ID NO: 77833 - DNA, 601 bp, Human
agaggttggcaggtgtcatctcaaagagctgtccctatggtgaagctctgcctttctgacaggccaaagagaagattctagtcaccacgaatcttaccggggtgttttgaggaggtgggggctagtaagcaggagggggctacattcctgaggctagagtcacataagaatccaccagccatctcattccacgaaaggaatttccatgactattcagccacagacttgctgtgcgggctttgacaagttgtttccctctctgggcctcagtttccccatctatacaattaagagttagacmaaggctgggcatggtggctcatgcctgtaatcccagcactttgggaggccgagccaggcggatcacgaggttgagagatcgagaccaacctagccaacatggtgaaaccccgtctctactaaaaatacaaaaattagctggacatggtggcaagtgcctgcagtcccagctactcaggaggccgaggcaggagaatcgcttgaacccaggaggcggaggttgcagtgagctgagatcacgccactacactccagcctggtgacagagtgagactctgtctcaaaaaaaaaaaaaaaagtt

SEQ ID NO: 77834 - DNA, 601 bp, Human
ggctttactatgaatagagcaatcagctcccctcataagcaccctgggacccactgtgagactgagcgagtctccagcctctctgaactctgcgtccccatccatatagagaggttggcaggtgtcatctcaaagagctgtccctatggtgaagctctgcctttctgacaggccaaagagaagattctagtcaccacgaatcttaccggggtgttttgaggaggtgggggctagtaagcaggagggggctacattcctgaggctagagtcacataagaatccaccagccatctcattccaygaaaggaatttccatgactattcagccacagacttgctgtgcgggctttgacaagttgtttccctctctgggcctcagtttccccatctatacaattaagagttagaccaaggctgggcatggtggctcatgcctgtaatcccagcactttgggaggccgagccaggcggatcacgaggttgagagatcgagaccaacctagccaacatggtgaaaccccgtctctactaaaaatacaaaaattagctggacatggtggcaagtgcctgcagtcccagctactcaggaggccgaggcagg

SEQ ID NO: 77835 - DNA, 601 bp, Human
aggtcactgcagcggggctggcctggctctggaaggctgggctggctatgtgggctgggccttcatggcatgcagcccccgaccctcctcccatgtggcactccatcctctccccttcaggctctcttctgctgggcctggggctgggggtggcttagagactctgagctaggaggtatgctttttgaatgggcagcagaggcccagagaaggacagaagcatgccccagtcacacagcaaaaaggcagattcaagctgtggggagaggacaggcaggcagtgtggatgccgtagggaggktgtaggcaccccagggatctcggactggctttactatgaatagagcaatcagctcccctcataagcaccctgggacccactgtgagactgagcgagtctccagcctctctgaactctgcgtccccatccatatagagaggttggcaggtgtcatctcaaagagctgtccctatggtgaagctctgcctttctgacaggccaaagagaagattctagtcaccacgaatcttaccggggtgttttgaggaggtgggggctagtaagcaggagggggctacattcctgaggctagagtcacat

SEQ ID NO: 77836 - DNA, 601 bp, Human
ggagtgaggggtggggtgtgctgagaagcccagcagggacctggaagctcccagccaatgaggggtccaagccgagtgccacagatccaccagaccgaggataggaggccaggggtgtgggccagaaggtgggatggggtctggagggccaatcaaaggatttgagctgatggttctggacaagcaggggcccactgacgctttctgagctgaagggctggcagctggaggcctccacagagcccactggaaatcctgaaaactaaagctgaagggcagggcagtgtgcctggtgcttcaygccctgccaccagcacacatcacccctgccagctccagggttccactccgcagccccccgggtcccctaccttatctcccatctacccacctttgagggccagagctggcatcgcacccggaagccgcatggtgtcctgcagagttaaacaggagtcagggcccagggcaggtggaggcagcgacaggggctatctcaccacctggctcctgcagaatgagccccagcttgggccacccagccttcatgtccgaggggctgaagtcaaaagccaccacgtcccaagcctgaaagggcact

SEQ ID NO: 77837 - DNA, 601 bp, Human
ccagctgccgggcaggctgctggctggtcattaattgctgggtcagtcgctcagcccctgcagagctgaagacatgttaacgggcaggagtgaggggtggggtgtgctgagaagcccagcagggacctggaagctcccagccaatgaggggtccaagccgagtgccacagatccaccagaccgaggataggaggccaggggtgtgggccagaaggtgggatggggtctggagggccaatcaaaggatttgagctgatggttctggacaagcaggggcccactgacgctttctgagctgaarggctggcagctggaggcctccacagagcccactggaaatcctgaaaactaaagctgaagggcagggcagtgtgcctggtgcttcacgccctgccaccagcacacatcacccctgccagctccagggttccactccgcagccccccgggtcccctaccttatctcccatctacccacctttgagggccagagctggcatcgcacccggaagccgcatggtgtcctgcagagttaaacaggagtcagggcccagggcaggtggaggcagcgacaggggctatctcaccacctggctcctgca

SEQ ID NO: 77838 - DNA, 601 bp, Human
gcagcaacaggttgggcaggccccccaaatcaggaggggccggggagaaatcagcctgcaagccagatatccacccgttcctggcccctcctccgacccctgcctggccccacattacttctttgcgggggtatgtccactcgaagttgaccacctcattcccgatcacaatgcacatgagggtgatgttctcaccctggcggaccacagtctgcactgcgttcacagagacgttgatggatgacactggtagagagagattggcttaggtctggggaagtcaccaccagccactagcacktcagcttggggatagggtagggggctagagagggaaaggatgactgatgtagaagattcattcattcaacaaatatttactgaatacctactacatgccaagtactattctggacactggagcaacagtagtgaacaaagtggacaaaatctctgttcttatggagctgacgttctagaagggataacagtctggaaatcaaagtaccctctggagatctatgtacaggagaaatgtattgagcacataacatgtgccaggtactctccatcttttatttaatcttcacaattgatccta

SEQ ID NO: 77839 - DNA, 601 bp, Human
gggactagtgataaggttgaatttggggatggggcttcccggacctgggatggcagttgggcttggaagtcaggttggggctggggctctggctagtcagaaagtctaggttgagatagggttggatttggggctgacactacattttggtttggggtttatcctggaattggggttttggttggcacagaggctagctagggctgcactggagtgtggctgactataccccggggctgtgacaggcactgggtccagctcagccctgatcactgtatcaaaaatgcaactctcaccatcrctctgcacccagcaaagtgggtgagggtggggagcgttgaaggaattggggattgggctgagcccaaggcacacaccaaccacggtgatgttgatggccttttcatcctgatggtcattcacactctccgtcacattgcaggtgtaggtccccgagtcttctaactcggcactggggatgtgcaggatggagcggatgtggtaaggcatatccaagaggaagtcagtcaccggctccaccagccgcccactctgcagcaacaggttgggcaggccccccaaatcaggaggggccggggag

SEQ ID NO: 77840 - DNA, 601 bp, Human
cagggaggggaagggcttgccaaggtcatctcggcattggtagcagagccgggactcaaaccaggtctcgtaaatcctcacccacaggcagttcccctaggccaagagggagggttgagatgaactgtgggtgggggtggggagcattgaaggaaagtcctatttctctccccttcagaaaggtggacactgctccatcctaacctaccacagtctctgtcagccagcaaatctccagcctcagggataccacaggccatgagtggcctgcctggcaccctcttccccagtcatctgcccrtttacttcttggctgctactgctggccccacccatcacaaggacaactaaacatctgggtgatcatctgaccggcgactgtttcctccactagactagaaactctaggagggatgaactgtcagctctggtcgctgcagcatccccagcacctggcacctaatatgctctcagaaagctgggcctaggtttgtggctgaaagccgagggctgcctggcggctgcaaagaaaaataacttcaagaatgggatgggagagcgagctgctcaccgggtctccgacacgttgcgcgtggacagg

SEQ ID NO: 77841 - DNA, 601 bp, Human
attcttcagtagacgatttacatatctacacacagaggatttgcacctatgttcaaggaacaggcatgctcatgtacatggcttacgacatacatatagtatatgtacaccacactgaaggatattcatatccatggcttacagacttgtgtttgtacacgtgtgtacccatattgtgtttgccagaatgtgttcctatgcatgtacacaacagggtttcacaatgctcctgtttgcccctgggcatgctaactcctttggcctgctgtgggtacatgggcacattaccaattaggcaggrttaaggtagggattgggatcgtcaggggccactgaggctggggactcacagtgtggcaccacgatgacctcctgcgtgtcctggcccacagcgttgcgcagcgtgcagcgcaccgacagtggccgatccacgtgctgcagacgcagtgtgctcaccacctcaaactcctgctcctcctcccagtacgtcacgttagtctccagctggctctcctcttcggaactgttccccagcagcgtgggcggcagctcacgtggacacctgccaggagagccggtagggttggctgccagccccttc

SEQ ID NO: 77842 - DNA, 601 bp, Human
catacactgtggggtttaaacagatgtctgggaattaggcatgctcatgtacatggcttacaaacacgtggtgggtttacatacatggacaggcatagtgcacaggtgtatgcttatacacatacactctagctttacaggagtgactggagattgggcattcttcagtagacgatttacatatctacacacagaggatttgcacctatgttcaaggaacaggcatgctcatgtacatggcttacgacatacatatagtatatgtacaccacactgaaggatattcatatccatggcttayagacttgtgtttgtacacgtgtgtacccatattgtgtttgccagaatgtgttcctatgcatgtacacaacagggtttcacaatgctcctgtttgcccctgggcatgctaactcctttggcctgctgtgggtacatgggcacattaccaattaggcaggattaaggtagggattgggatcgtcaggggccactgaggctggggactcacagtgtggcaccacgatgacctcctgcgtgtcctggcccacagcgttgcgcagcgtgcagcgcaccgacagtggccgatccacgtgctgcaga

SEQ ID NO: 77843 - DNA, 601 bp, Human
ttttcaggttttcacctaaaggttccttttctagaatactttcctgaatcccatagctgggcatgggaccccttctccctccaggctttgcccctaatgtggtgatcccggagggaattgccaagttccttgtctgccttctctctctggactatgggtactaggaggtccaggcagggctgagccctttgacctttatacttcaatgagaagttgggtcctcatatttatcgaatgaagaagaaaggtgaataaatgaagcacactcatacaggtgcatgtatgcataaggacgggcagstagatacacaaaagcatcaagacactggtaggcattgttcatacgcacagaaattacacgtgtatgtgtacctgctaacagatgtacattgtacagcaggcacatgtgtacgggaattatgcttgtacacttttctagaaaggtgtgctccaattatatgcttacagacatgcactatgccagtttgcatgcatgcaaaggaattgtacatgcattgcttgtacacatgtacaggaattgtgtacccaccggtacatgcatacagacatacactgtggggtttaaacagatgtctgggaa

SEQ ID NO: 77844 - DNA, 601 bp, Human
tctgggcttttacacaggccattccctctgagtgggacaccattccttaccaggctaacttctagtcatttttcaggttttcacctaaaggttccttttctagaatactttcctgaatcccatagctgggcatgggaccccttctccctccaggctttgcccctaatgtggtgatcccggagggaattgccaagttccttgtctgccttctctctctggactatgggtactaggaggtccaggcagggctgagccctttgacctttatacttcaatgagaagttgggtcctcatatttatygaatgaagaagaaaggtgaataaatgaagcacactcatacaggtgcatgtatgcataaggacgggcagctagatacacaaaagcatcaagacactggtaggcattgttcatacgcacagaaattacacgtgtatgtgtacctgctaacagatgtacattgtacagcaggcacatgtgtacgggaattatgcttgtacacttttctagaaaggtgtgctccaattatatgcttacagacatgcactatgccagtttgcatgcatgcaaaggaattgtacatgcattgcttgtacacatgta

SEQ ID NO: 77845 - DNA, 601 bp, Human
tgagccccattaggttcgtccgtctaggacacatggggcaggagaccctgaggcccagagaggggcaggggcatatttgaagtcacacagcaagtgctcaactgagccaaggtcttcgtgggctcggagggaacagggaccaaggggccccagaggaggcttcaggacttggcagactgaggagcaactggcagctgagggcctggctcatgagaacctcctctctagcttctctcccagccttcgctgctcctcagatggaagtagtagagcaggtgaccccagaaagtgacaccaggtrgggtactcggctggatgcggatggccctccccagtgctgggcaagtcagaaagatgtaagcttagaatgttgacatcttaaggtgttggaaccacaggactggaattttagaaagatgggatcatgaggtgctgtaatcctgattcaggaagcttaaaatgttggaatcacagaatggtaaaatctcaaagcagaacactgaaattacagactaataggatcagaatgcatttcagtagaatcacaggttctccatgggtgagacctggaagaatcctggagcccatgcagtccacctca

SEQ ID NO: 77846 - DNA, 601 bp, Human
acccagcacaagctggtcccgcggcagctcccacgtggagtcatagggcagctgcatggggtccacgtagatgtactcatggccgtcagagctcacagactcaatcaccttccatcggatctcgtaacgtggcttctggaggaccaaccccaggaattagttatcagagggagtctcaggccctgagccccattaggttcgtccgtctaggacacatggggcaggagaccctgaggcccagagaggggcaggggcatatttgaagtcacacagcaagtgctcaactgagccaaggtcttcrtgggctcggagggaacagggaccaaggggccccagaggaggcttcaggacttggcagactgaggagcaactggcagctgagggcctggctcatgagaacctcctctctagcttctctcccagccttcgctgctcctcagatggaagtagtagagcaggtgaccccagaaagtgacaccaggtagggtactcggctggatgcggatggccctccccagtgctgggcaagtcagaaagatgtaagcttagaatgttgacatcttaaggtgttggaaccacaggactggaattttagaaagat

SEQ ID NO: 77847 - DNA, 601 bp, Human
gccactcacctcctgtagtgtggcccagttccagtaccggtctgtggaccaggggttggggaccccttgacctaaagcacagcaatatctgagtaaaacaattatcaattatatctagtgaaaagggaactggaacagactatcaagcaatgatgagtatgtttttgcaatataaaagggacaatgccagtgatgaccagctcccaactcccggaaaaaaagagatttcatatgcattcccaagtcaagagacatgcattaccaccaacatatcatctactaaataccattaacaagagcmacaaaatatttttaagcaaaggctaaaataacctactctcctgacggtctaagtgaaacaaaaactcttaacgatctacgtacaatcctctaattgatttaagtcagctactcttgaaaaacccaaatacataatacatctacactaatttttaaatccagaatgtgtcctgggtttagtgattcagagtatctaaatctacatatacataaaattatcttctctttgggaacaagcttccaaaaatgtcatcttttgctactgacggcatgcatgtgtgtataaaatccaattataagt

SEQ ID NO: 77848 - DNA, 601 bp, Human
agaaaatgaaagccaactaacagtctccaccaaggtcaaaacaatggtagttggaaggacacagaggcaactctagtgaaagatttctagaattctgcagtcaagacatatgaactgccttcatctttatcaccaagtattacaaccagtcgtaaacaacggtcaggacagctcttttgcaaggaggtcaaagtcctgccaacatcgaatcctgcagaatactcttataagtaaaacctcagtacgtaaatacaatccatatttaaccaaaacaaaagctgaggctcagagaagttaaatsaagtgccaagggtcggggagggctttggggtgattcaagcacattacatttacggtgtactttatttctattattacactgtcatatatcatgaaataattttacaactcaccataacgtagaatcaatgggagccctgagcttgttttcctgcaactagatggtcctatctgggggagaggggaaacagtgacagatcatcaagcattagattctcataaggtgtctgcaaactagaaccctcacttgtgcagttcacaatagggttcacgctcctatgagaatctaatgccgtggctg

SEQ ID NO: 77849 - DNA, 601 bp, Human
gaagaaaacgaggtttaattggacttacagttccacatggctggggaggcctcagaatcatggcaggaggcaaaaggcacttcttgcatggcggcagcaagggaaaatgaggaaggagcaaaagcggaaacccctgataagcccatcagatcttgtaagacttattcactatcatgagaatagcataggaaagaccagcccccatgattcaattacctccccctggatccctcccacaacacgtgggaattctgggagatacaattcaagttgagatttgggtggggacacagccaaaccrtatcactgactatagacctaatcctggcaggaatttaagcaggatacactagcaggtgaagacagtccagaatttgaggagtttgctttgtctgctgatttgctccttcttaaacaaggctataagaaaaaggcaaatgggatggaatatttcacttagaagtgcctgtcagtgagtttgatcttccaagaaaatgaaagccaactaacagtctccaccaaggtcaaaacaatggtagttggaaggacacagaggcaactctagtgaaagatttctagaattctgcagtcaagacatatg

SEQ ID NO: 77850 - DNA, 601 bp, Human
gtctctaggaagttccaaactttcccacattttcctgtcttctgagcccttcaaactattccaatctctacctgttccccagttccaaagtcatttccacattttcaggtatcttttcagcaacgccccactctactggtactaacttactatattaggttattttcatgcagctgataaagacatacccgagactgggaagaaaacgaggtttaattggacttacagttccacatggctggggaggcctcagaatcatggcaggaggcaaaaggcacttcttgcatggcggcagcaaggraaaatgaggaaggagcaaaagcggaaacccctgataagcccatcagatcttgtaagacttattcactatcatgagaatagcataggaaagaccagcccccatgattcaattacctccccctggatccctcccacaacacgtgggaattctgggagatacaattcaagttgagatttgggtggggacacagccaaaccatatcactgactatagacctaatcctggcaggaatttaagcaggatacactagcaggtgaagacagtccagaatttgaggagtttgctttgtctgctgatttg

SEQ ID NO: 77851 - DNA, 601 bp, Human
ttgggaaagccattcaacaagtctctaggaagttccaaactttcccacattttcctgtcttctgagcccttcaaactattccaatctctacctgttccccagttccaaagtcatttccacattttcaggtatcttttcagcaacgccccactctactggtactaacttactatattaggttattttcatgcagctgataaagacatacccgagactgggaagaaaacgaggtttaattggacttacagttccacatggctggggaggcctcagaatcatggcaggaggcaaaaggcacttyttgcatggcggcagcaagggaaaatgaggaaggagcaaaagcggaaacccctgataagcccatcagatcttgtaagacttattcactatcatgagaatagcataggaaagaccagcccccatgattcaattacctccccctggatccctcccacaacacgtgggaattctgggagatacaattcaagttgagatttgggtggggacacagccaaaccatatcactgactatagacctaatcctggcaggaatttaagcaggatacactagcaggtgaagacagtccagaatttgaggagt

SEQ ID NO: 77852 - DNA, 601 bp, Human
tggaatatctcctctaatgccagtgaagtagaattagaggcaatgtctgtggactactaaatttgctgggtttctgtggactactaaacttgctgggtttctggctcataccttcctggataagaaatttccaaacactgaatgactgtatagtccattttcatgcagctgataaagacatacccaagactgggacgaaaaagaggtttaattggacttacagttccacatggctgaggaggcctcagaatcatggtgggagacaaaaggcacttcttacatggtggcagcaagagaaaakgaggaagatgcaaaagcagaaacccctgataaactcatggacagcggccctcttctcacaaccccactaggcagtgccccagtagggactctgtgtgggggctccaaccccacatttcccttccacactgccctagcagaggttctccatgagggccctgcccctgcaacaaacttttgcctgggcatccaggcatttccatacatcttctgaatctagaaggaggttcccaaacctcaattcttgacttctgtgcacctgtgggctcaacaccacatggaagctgccaaggcttggggc

SEQ ID NO: 77853 - DNA, 601 bp, Human
tgggaggattgcttgaagccaggagttcaagaccagcctgggcaacaaaagggagccccacatctctacaaaaaaaaaaaaaaaaaaaaaattggccaggcctgtggcatgtgccgcagtcccagctacttttggagggtaaggcaggaggactgcttaagcccaggagctcaaggctgtagtgagctatgatggcaccactgtactccagcctgggagacagagcaagaccctgtctctaaaaatatataaataaaataaaaaataaaattagccttaataaaaatgtgaacccaaaaakctctagagaactaactcatctacccagcaaagctcccatatgcacagtccattcctattctcctctctgttggaatatctcctctaatgccagtgaagtagaattagaggcaatgtctgtggactactaaatttgctgggtttctgtggactactaaacttgctgggtttctggctcataccttcctggataagaaatttccaaacactgaatgactgtatagtccattttcatgcagctgataaagacatacccaagactgggacgaaaaagaggtttaattggacttacagttccaca

SEQ ID NO: 77854 - DNA, 601 bp, Human
aacccatcacctaggtattaagcccaagaatgaaaattttaaaatacagacataacatagttaacaaatagggattgggcgctaaaaagaagcaataggactgcaacggctaaaagcataacatcccaaatgatgtttggctttaaaatgcacgttagggatgggcctggtggctcatgcctgtaatcccagcattttgggaagccaaagtgggaggattgcttgaagccaggagttcaagaccagcctgggcaacaaaagggagccccacatctctacaaaaaaaaaaaaaaaaaaaaaattggccaggcctgtggcatgtgccgcagtcccagctacttttggagggtaaggcaggaggactgcttaagcccaggagctcaaggctgtagtgagctatgatggcaccactgtactccagcctgggagacagagcaagaccctgtctctaaaaatatataaataaaataaaaaataaaattagccttaataaaaatgtgaacccaaaaagctctagagaactaactcatctacccagcaaagctcccatatgcacagtccattcctattctcctctctgttggaatatctcctctaatgc

SEQ ID NO: 77855 - DNA, 601 bp, Human
aatcttcaaaaacaacattagaagggggaaccattattaacctcattttacagatgaagaaactgaaacacagggcggggaagaaatgtttccagggtcacatgaataataaatacaactgtgcattacacttatttttcttctgtaacttcaaacaaacagaccatttcaaaaagtgaaaaatctctctcaaacaaaaggtttgttatcctttctggagaaagaattcgctctcaatgtgagaacaggatttaatatctaatttgtaataaagaagctaagcactaaggcagatacaacraaaaggagaaagagagggagttcacaataaaacacacccaggctctatccaatgcagttacctgaccttattacccaacagcattacagggaggcaagagggtcaaatggtaagggcatttgactgagactagggaaacaaactctcatctccatccttcttcaaataacgagtcattggccaggccccttaacctccctaggtatcctctgcccttctataaatgagagacctggacaagaagcagatactccttccagctccattactctaagcattaattcaaatgaggtgtattga

SEQ ID NO: 77856 - DNA, 601 bp, Human
atcttttaaaggttctccagtattcacaggaatacacagtctcctgacaacatatcatgtctagcaggtcactacactcattaaaaagttaactccgtgttgagattccaatactctcagtatattaaaccaaaggctagcatttttactgagggtttcagtgcaccaaattttactgagtgtttcagtgcatcatcactgccaggtgcagtggctcacacctgtaatcccagcactctgggaggtgaattacctgaggtcaggagttcgagaccagcctggccaacacagcgaaaccctrtctctactgaaaatacaaaaattagccgggactggtggctcatgcctgtaatcccagctactcgggagtttgaggtgggagaatcgcttgaacccaggaggcagaggttgtagtaagccactgtactccagcctgggcaacagagtgagactccgtcaaaaaaaaaaaaattgtgatggaaatttagctacacataaaaaatgagtgtgctggagaagaactggaggaatgtgccagcaaggtgatggccctacagccaagacatcaagacagagccacccaaactgctataatttcaga

SEQ ID NO: 77857 - DNA, 601 bp, Human
tacctgtcccaccactcgtgctcacacttcttagtcaagacatcttcactttacaataccaggatgtacacaggagaccccaagaaaggtaagttagccaagaccgtattttaaaagccaagaactaaaatatcttttaaaggttctccagtattcacaggaatacacagtctcctgacaacatatcatgtctagcaggtcactacactcattaaaaagttaactccgtgttgagattccaatactctcagtatattaaaccaaaggctagcatttttactgagggtttcagtgcaccaaattttactgagtgtttcagtgcatcatcactgccaggtgcagtggctcacacctgtaatcccagcactctgggaggtgaattacctgaggtcaggagttcgagaccagcctggccaacacagcgaaaccctgtctctactgaaaatacaaaaattagccgggactggtggctcatgcctgtaatcccagctactcgggagtttgaggtgggagaatcgcttgaacccaggaggcagaggttgtagtaagccactgtactccagcctgggcaacagagtgagactccgtcaaaaaaaaaaaa

SEQ ID NO: 77858 - DNA, 601 bp, Human
tccctacctgtcccaccactcgtgctcacacttcttagtcaagacatcttcactttacaataccaggatgtacacaggagaccccaagaaaggtaagttagccaagaccgtattttaaaagccaagaactaaaatatcttttaaaggttctccagtattcacaggaatacacagtctcctgacaacatatcatgtctagcaggtcactacactcattaaaaagttaactccgtgttgagattccaatactctcagtatattaaaccaaaggctagcatttttactgagggtttcagtgcaycaaattttactgagtgtttcagtgcatcatcactgccaggtgcagtggctcacacctgtaatcccagcactctgggaggtgaattacctgaggtcaggagttcgagaccagcctggccaacacagcgaaaccctgtctctactgaaaatacaaaaattagccgggactggtggctcatgcctgtaatcccagctactcgggagtttgaggtgggagaatcgcttgaacccaggaggcagaggttgtagtaagccactgtactccagcctgggcaacagagtgagactccgtcaaaaaaaa

SEQ ID NO: 77859 - DNA, 601 bp, Human
tccatagctactgaatactgggaaatacagccagaattctacattttactagaaaataataacagtaggcttttctgatcacatatgtaagaaaatccttttaacaaaacattaacaatactatgtaaaatagtgacaggcctactgcactatattctcaataatcacataattacacttaatgaaatatagagcacgcaagaagatctggcatgagtttacattattatttgataaggaacttaaacagccaggccctgaaacttagataatttggatatgtttctcatcagatttaaamaagcttaacactgtgattttccatttcaagtaattctcaacccttttctgcctccctacctgtcccaccactcgtgctcacacttcttagtcaagacatcttcactttacaataccaggatgtacacaggagaccccaagaaaggtaagttagccaagaccgtattttaaaagccaagaactaaaatatcttttaaaggttctccagtattcacaggaatacacagtctcctgacaacatatcatgtctagcaggtcactacactcattaaaaagttaactccgtgttgagattccaata

SEQ ID NO: 77860 - DNA, 601 bp, Human
aaccccacaagtgccatcagttcccctagaggggagtgtgttttccttccgtgcaggaatttaggccatggctaaatgaccatctgtcagagatgctggaggtgaggattccccccaagtgagaggctggattaagtgtcctttaaagccccttccaactctaaaattgtataattccatgagatcagcaaaggctaaaacagtaataggaagcttcagagaggaagggaaacttgaactaagcccaaaatgatagccaggacctaagtaaacaagacagagcaaaagatccctcattttmttccttttcattaaatatatgccaggtcagtctgcaaagcttaatgggattaatgactggcacagtcaggaagatttccatagctactgaatactgggaaatacagccagaattctacattttactagaaaataataacagtaggcttttctgatcacatatgtaagaaaatccttttaacaaaacattaacaatactatgtaaaatagtgacaggcctactgcactatattctcaataatcacataattacacttaatgaaatatagagcacgcaagaagatctggcatgagtttacat

SEQ ID NO: 77861 - DNA, 601 bp, Human
gcagcagatgtgaaaccagagaatatggtgggcccgctgtacatttagtcaatgaaattggattaaactgtctcactcacgctgctaatgggcctgactttgaaactatgaatggaaactcttctatgctattttttaatatgtcaaaaaagtagtacccatggactggttttggtgcattctgcattattttaaataacatagaaaatatttttttaaaacctttctatcacgatctctggccctacagtttcactgacaaggctattcacttattcactcaataaaaaggtatcttcawacttactatgtgccaggaacagtatagttactataaagacaaatacaaatacctgccgggaagtcacaatctagtgacagacccagaaacatatgattaacaagagaaggcagtggtaattttagagacagggacaaagtgatctggggactagcacccatgagacagcaaggctaaaccccgtggcacagataacaagtcctttcaaagttcacaaccccacaagtgccatcagttcccctagaggggagtgtgttttccttccgtgcaggaatttaggccatggctaaatgaccatct

SEQ ID NO: 77862 - DNA, 601 bp, Human
catataacctgtgcacatccccctataagctttaaattatatgtaaattacttataatacctaatacaaggtaaatggtttatagttatattgtatataactatacaatatttatattataaagttatattgtatcggttttcggttttttattttcattattttcaattgttgtgttgttattttattgtggggtttttttttcaagttttttaatccacagttggctaaagcagcagatgtgaaaccagagaatatggtgggcccgctgtacatttagtcaatgaaattggattaaacygtctcactcacgctgctaatgggcctgactttgaaactatgaatggaaactcttctatgctattttttaatatgtcaaaaaagtagtacccatggactggttttggtgcattctgcattattttaaataacatagaaaatatttttttaaaacctttctatcacgatctctggccctacagtttcactgacaaggctattcacttattcactcaataaaaaggtatcttcatacttactatgtgccaggaacagtatagttactataaagacaaatacaaatacctgccgggaagtcaca

SEQ ID NO: 77863 - DNA, 601 bp, Human
aacagagcaccaggtggcaatggtaaatacagtcactttgccagattaaaaaaaaaatgcttaattatataccatgtaatagaatgacgtgatgacttcttacatagtccttattgcccatttgtttttcagaaactcagtgtgtgctaatcctccctgagaaacagagttctgatttcaattctattcatcaccagaatagtcatgtcacaacagagagatgataggtgaatgatcacgtgttcactttcatctgctgagtttttccaggtaaggctgtttttttttttattttttgagmcagagtctcgctctgtcacccaggctggagtgcagtggcgtgatctcggcgcactgcaacctctgcctcccaggttcaagcaattctcctgcctcagcctcccaagtatctgggattacaggcatgcgccaccacgcctggctaattttgtatttttagtagagacggggtttcaccgtgttggtaaggctggtctcaaactcctgaccttaggtgatccatccacctcagcctcccaaagtgctgggattacaggcatgagccaccgcgcccagccaggtaaggctttttaatgtcagt

SEQ ID NO: 77864 - DNA, 601 bp, Human
ttccaatgccagggttagatacagacctggtggtactgtttccctgtataaaactgaagatacatcaaatggaaaaaatgtgcccacgtaagaatttgaaagataccagttgccttactctaaaaaagacatatcaaatttagaagtgtgccatcttaatcttcaatcaaagaaaaatttaaaactgcaatctagcaaactagttttcctgaatgtttttctctttttaatgcaaaaaccattcttcttttgtcaaaaaaaatttctatacacttggttttataagtaaaataatctaaasaatgctttcaaagggtaaattttacatagcttagtcacggcacgaacagagcaccaggtggcaatggtaaatacagtcactttgccagattaaaaaaaaaatgcttaattatataccatgtaatagaatgacgtgatgacttcttacatagtccttattgcccatttgtttttcagaaactcagtgtgtgctaatcctccctgagaaacagagttctgatttcaattctattcatcaccagaatagtcatgtcacaacagagagatgataggtgaatgatcacgtgttcactttcatctg

SEQ ID NO: 77865 - DNA, 601 bp, Human
caggaagacctcgtctctacagaaatatattttcttaaaattagccaggcatggcggtactcgtgtgtagtctagctactcaggaagctggagcgggaagatcgcttaagcccaggagttggaggctgcagtaagctatgatggcgccactgtactccagcctgggcaacagagggagacactctctcaatctatcaatcaatcaaattgcttctgtggaagacattatctttttcttatttctactcttaaaggtataaagatgcatacaaaagtccctgtcctgaaagaaatgcacatrgaaggagaaatacagcacagaagatgttcttaagctgaaatgaatgataagcattctatcatataagtatattcaagaatggcaccagatttagaatagggttatggccaaaacacatgagtaataacagtaaactattataataaatttccatgacaacagaaatgatcccagatcatctttccagagagagagccaagtccattccccacagagatggcatatgctaagagctggaatatctttcaggctttgcaaactagccctggctgtcatgggtatcattattcactcctccct

SEQ ID NO: 77866 - DNA, 601 bp, Human
gcgctccagcctggacaacagagccagaccatgtctcaaaaaaaaaaaaaaaaattactcctaaggaagcccaggttgccatggctcacacctgtaatcccaacactttgggaggccaaggtgggaggatctcctgaggtcaggacatcaagaccaccctgagcaacacaggaagacctcgtctctacagaaatatattttcttaaaattagccaggcatggcggtactcgtgtgtagtctagctactcaggaagctggagcgggaagatcgcttaagcccaggagttggaggctgcagtragctatgatggcgccactgtactccagcctgggcaacagagggagacactctctcaatctatcaatcaatcaaattgcttctgtggaagacattatctttttcttatttctactcttaaaggtataaagatgcatacaaaagtccctgtcctgaaagaaatgcacatggaaggagaaatacagcacagaagatgttcttaagctgaaatgaatgataagcattctatcatataagtatattcaagaatggcaccagatttagaatagggttatggccaaaacacatgagtaataacagta

SEQ ID NO: 77867 - DNA, 601 bp, Human
tcaagagactaggctcttgatgagaggggatgtatgatttctatactgtagaagatgaaaatgtggcacactgtgatcacaaaggcatgtcgataccatggagtagacctaccgattagtttcatcgatccttacacttcgaacacttcacacccccttcccaatcactcttcctatgttgcaacttgaggaccatgattttgttttatttttccccttctggcttataaatactaaaagttttaattttaaaattaatccggggtgggcacagtggctcatgcctgtaatcccagcactktgggaggctgaggcgggtggattgcttgagctcaggagtttgagaacagcctgggaaacatggtgaaaccccattgctacaaaaaattagccaggcatgatggcacatgcctgtagtcccagctattcaggaggctgaggtgggaggatcacttgagcccaggaggtggaggttgcagtgagccaagatggtgccactgcgctccagcctggacaacagagccagaccatgtctcaaaaaaaaaaaaaaaaattactcctaaggaagcccaggttgccatggctcacacctgtaatccca

SEQ ID NO: 77868 - DNA, 601 bp, Human
agctgaggacacaatggaatggatgtaggttcctactgcttccctagttcttcataacatgagcatctgaagtttgcaggtgaacacagcctacagagtaagaaacctgcacgtgagaagggccaagggaagaagcactggcacactgactttccaacattaggctgggagaagggccccatcaacactgcacggtccacctacaaccctataatgcaactccaggctcctgcgcagtgacgacagcccttctcattttatttcttactgcaccatcagcctagcaaaggcctggccatgrccttcaacacagcatcatgaactaagaacactgtgtggaaaaaaggagaatctaaaagcttccagggagggaaaaaaaaatcacattaaaaggatcaggaatcaaaatgtcaagtgaattctcaatagcaacaatagatgctagaaaataatcgatgtaacttccatgtttggagaaattccatcctagaatcctatatccagctaaaacaagtaggcaggggctaggataaagacattttcagacatacaagttctgaaaaaatttacctctcatgtgccctttctcaaaaagctacca

SEQ ID NO: 77869 - DNA, 601 bp, Human
gggttaaaccccattggcagacactggcagactgcaaggtgggatggtgaaggctgggcatgtattttgctgtcttcctccctgtcagactgtcatttgttgactatggctcttcaccaaagccatagctctgattagcagacttctcccacaaggccaatctcaacagtttatggtaatttctccctctccttacctcttcatgcccaggactgctaaagtaccagtttctgttgccagccctgggggattgcaccacatcaagtttgtttcccttaaccctgcccacaccaatataaayagccttagagtttagtaccagtactgattgtaaaaactttgcctgaaaaaactcagcagattaaaatgaacaagggaacatctgtctatcatctacctatctgtcatgacatgactattcaggtgttgaatggaactgaaactagaactctattcctcaggaaggattagcacacactgagtttccaaagaataaatgggcaacaaggattacgtaagaagccaccatgtcattctattacatagtgtagaactaacatgataaaattttacctggcaaaattatttatccatgcagagg

SEQ ID NO: 77870 - DNA, 601 bp, Human
actcacctcctcaccatcttccaccctgctctgcgctccaggaggacgacctttatggaagacatcaaaggatgcccttgctgtctggcttccaggtgggttaaaccccattggcagacactggcagactgcaaggtgggatggtgaaggctgggcatgtattttgctgtcttcctccctgtcagactgtcatttgttgactatggctcttcaccaaagccatagctctgattagcagacttctcccacaaggccaatctcaacagtttatggtaatttctccctctccttacctcttcaygcccaggactgctaaagtaccagtttctgttgccagccctgggggattgcaccacatcaagtttgtttcccttaaccctgcccacaccaatataaacagccttagagtttagtaccagtactgattgtaaaaactttgcctgaaaaaactcagcagattaaaatgaacaagggaacatctgtctatcatctacctatctgtcatgacatgactattcaggtgttgaatggaactgaaactagaactctattcctcaggaaggattagcacacactgagtttccaaagaataaatgggcaa

SEQ ID NO: 77871 - DNA, 601 bp, Human
ttgcgttgctgaggatctcctctatacctggtctgccgtgaagaggggttcatcattaacacaggagacgatgattgagtgcatatccagctgttctctcagctcttcatcatctgatgtatcaaagagcaaactgtcacttacctaaaaacaaaaatacccatcattaaaagcaggacatcctcatcaaaacaaagttaacagctctgagtaaaagaggctgcagagaaaagcaactactaagagccttccctcaagagggagaaattattacaatcactctgtaccaggcaatgagtayatattcatcttgaacagaaatgagaagaatgtagaataaatatgaaatcactgagatgctgcataagactgctataaaagctgacagatatgcagaaaaaaatacggtattcattagcaagtcatagggaattacagtgaatagaagggagaatatgggcagggttagcaacacacactaagattggtagacgttaacattctaaagaaaacataaaagttagttacttgcaaactaacttctaatatctgagtaaaagatgatcaactccctgaaaggcgggatctgtccatgagcgtc

SEQ ID NO: 77872 - DNA, 601 bp, Human
ttggaaaccttcccaactaacataatcccttctgcttcagatcacaaatacttatttttctctgtggaagagttaactattaagcctgtataaccagaaaaaaataggaaagataagtaaaccaacagccatcatttactgtcataacaagaagccgtttttcagctctagagtctcctttccttgcgttgctgaggatctcctctatacctggtctgccgtgaagaggggttcatcattaacacaggagacgatgattgagtgcatatccagctgttctctcagctcttcatcatctgaygtatcaaagagcaaactgtcacttacctaaaaacaaaaatacccatcattaaaagcaggacatcctcatcaaaacaaagttaacagctctgagtaaaagaggctgcagagaaaagcaactactaagagccttccctcaagagggagaaattattacaatcactctgtaccaggcaatgagtatatattcatcttgaacagaaatgagaagaatgtagaataaatatgaaatcactgagatgctgcataagactgctataaaagctgacagatatgcagaaaaaaatacggtattcattag

SEQ ID NO: 77873 - DNA, 601 bp, Human
gtccgtgtttgggtaaatctaaagaaacaaggaaattcacaatatttttctggtttggggttaagcaacaacctttccttggtaccttgctataatcttcaacaaggcctctgttggaaaccttcccaactaacataatcccttctgcttcagatcacaaatacttatttttctctgtggaagagttaactattaagcctgtataaccagaaaaaaataggaaagataagtaaaccaacagccatcatttactgtcataacaagaagccgtttttcagctctagagtctcctttccttgckttgctgaggatctcctctatacctggtctgccgtgaagaggggttcatcattaacacaggagacgatgattgagtgcatatccagctgttctctcagctcttcatcatctgatgtatcaaagagcaaactgtcacttacctaaaaacaaaaatacccatcattaaaagcaggacatcctcatcaaaacaaagttaacagctctgagtaaaagaggctgcagagaaaagcaactactaagagccttccctcaagagggagaaattattacaatcactctgtaccaggcaatgagtatatat

SEQ ID NO: 77874 - DNA, 601 bp, Human
gcttgccataatgtatctccttactgatctcatctttccagcctaaaaatagagtgtggtagaactcacagtccgagtagccatggaacattttatttcaggaagaagttctggcatcacatttcaacaatacaacagaggtgggaagagtattcagaaaatgagaaagctgattcgactggttttaagtgaatacagggttgaccttattagcgcattccacgggaataatgctcacttctttctggggcacacaatatgttactttaatacatgctaatgctttttacccagggttttraagatactaaataatttctacacagatactttacagtttgtccgtgtttgggtaaatctaaagaaacaaggaaattcacaatatttttctggtttggggttaagcaacaacctttccttggtaccttgctataatcttcaacaaggcctctgttggaaaccttcccaactaacataatcccttctgcttcagatcacaaatacttatttttctctgtggaagagttaactattaagcctgtataaccagaaaaaaataggaaagataagtaaaccaacagccatcatttactgtcataac

SEQ ID NO: 77875 - DNA, 601 bp, Human
caaatatgactaaggaggatccaaataacacaattttaatgtaaatttttaatgtactcctcccaagcttgccataatgtatctccttactgatctcatctttccagcctaaaaatagagtgtggtagaactcacagtccgagtagccatggaacattttatttcaggaagaagttctggcatcacatttcaacaatacaacagaggtgggaagagtattcagaaaatgagaaagctgattcgactggttttaagtgaatacagggttgaccttattagcgcattccacgggaataatgcycacttctttctggggcacacaatatgttactttaatacatgctaatgctttttacccagggttttgaagatactaaataatttctacacagatactttacagtttgtccgtgtttgggtaaatctaaagaaacaaggaaattcacaatatttttctggtttggggttaagcaacaacctttccttggtaccttgctataatcttcaacaaggcctctgttggaaaccttcccaactaacataatcccttctgcttcagatcacaaatacttatttttctctgtggaagagttaactatta

SEQ ID NO: 77876 - DNA, 601 bp, Human
gaaatacatttgactttaaacaatgatctactgtctagtgcagtgctgctcaaatcttacaacagtatcttgcccttttccagattctaaaagttgagaaggatatagaactcagcgaaaatgtaaaggaaacccaggaaaattactcaatagttagaaaaaaggacctaaagttaaaaaaaaaaattaaacacaattaaatgaaggagtaagacatcatgagcatatttccatgctttatgaattaacaagcttaacaggtaagatttccaccaaggaaaaacaaaggcaaatctgaagsagatgggattatgttaattataagaagagtctccaaaacaggaaatataataaggtacaatgagccactcaaggatcctacagaatctgttattctaactcttaaaaaaagggagagtttacggtattaggcaggtcagtgaggggacaatgaattctcaaggtcatgtctatccctagattaccctctacctcaaaacaaccttccaacctactattaccttgcttttttaagcaccacattcttcccacgcctagaacaattcaaccacaaatatgactaaggaggatccaaataaca

SEQ ID NO: 77877 - DNA, 601 bp, Human
aatatacaaaaggaaaatgatctatctggaacacagtgctcacctaaggcacccagagcagaaatgcactgaattctccattaaccaatggtgttcaggtgtggatgctccaaataatcaaaattttgactgtaggagtgaacatggtttatcaagaaaaaattacaatatactaaacacaaacctaaatagaattggatttactacgtccatcatgattcagaaggccctaacatgtcttgcaaagtctaggtaatcgtgctacaaacacataataatttacttcagacacaccagagcyagatcatacagtaatcgttagaagaaagcaaataacagaaaatttaccatagacatacaagtgctcaatttaaaggtatctcatcaaaaattctgacataaaatttataaaatacaatagcacaaaaaaagtatatataaatgggaaattacctctatgacagcaaaatattctttcaacagcagaaaaataattttatatattaattcaacgaaaaaaagggattttttaaattactcaaaaagtagaagtccaaagagaaaaatgctgtgaaaagcagaaaaacttcagaaatacatt

SEQ ID NO: 77878 - DNA, 601 bp, Human
actttgggaggctaaggcgggcggatcatgaggtcaggagttcgagaccagcctggccaacatgacgaaaccccgtctctactaaaaatgtaaaaattagccaggcgtggtggcgggcacctgtaatcctagctacttgggaggctgaggcagaattgcttgaacccgggaggcacaggttgcagtgagctgaaatcatgccacttcattccagcttgggccaaaaagtgaaatcccgtctcaacaacaacaacaaaaatgtaaatttggacacaaacacaaacagaaggaggatgaaatyaaagctttctggagatgatcatactatacatttgatacagacaaaaagcacagaaatcattgatttcagcaggctcccttactctcttcataactgccggtactagacctcttgagagtttgaatttcctgggaaagcattgaaagccgatctgactgtgtaggggtttcatcatcttctgggtccggtgattcctgcatcatttcttcaatttcttcaataaccttcgaaaacacacacaccactgttaatcaaatatacaaaaggaaaatgatctatctggaacacagtgctcaccta

SEQ ID NO: 77879 - DNA, 601 bp, Human
cacaagactatttgtacaaacaggaattgcatttgacaaataattactgaatatctattctacacttcaaatatgatggggtttcttatagactcaattgtgtcctccccaaaattcatgtgttgaagtcctaaccccaagtacctcagaatgttacagtatatggtctttaaagaggtaattacattaaaataaggtcattaggatagaccctaatccaatatgattgctgtccttgtaagaggaaatttggggccaggcaatggtggctcacgcctgtaactgcagcactttgggaggmtaaggcgggcggatcatgaggtcaggagttcgagaccagcctggccaacatgacgaaaccccgtctctactaaaaatgtaaaaattagccaggcgtggtggcgggcacctgtaatcctagctacttgggaggctgaggcagaattgcttgaacccgggaggcacaggttgcagtgagctgaaatcatgccacttcattccagcttgggccaaaaagtgaaatcccgtctcaacaacaacaacaaaaatgtaaatttggacacaaacacaaacagaaggaggatgaaatcaaagctttctg

SEQ ID NO: 77880 - DNA, 601 bp, Human
gctgttcacaggctggttatatttattcagacatttttcatgaaaatcaactgtagagtttctagagttcattattctcacatatgtcaaacagatccatggttcccaaaattcttcatagtaacacacaagactatttgtacaaacaggaattgcatttgacaaataattactgaatatctattctacacttcaaatatgatggggtttcttatagactcaattgtgtcctccccaaaattcatgtgttgaagtcctaaccccaagtacctcagaatgttacagtatatggtctttaaasaggtaattacattaaaataaggtcattaggatagaccctaatccaatatgattgctgtccttgtaagaggaaatttggggccaggcaatggtggctcacgcctgtaactgcagcactttgggaggctaaggcgggcggatcatgaggtcaggagttcgagaccagcctggccaacatgacgaaaccccgtctctactaaaaatgtaaaaattagccaggcgtggtggcgggcacctgtaatcctagctacttgggaggctgaggcagaattgcttgaacccgggaggcacaggttgcagt

SEQ ID NO: 77881 - DNA, 601 bp, Human
ccacctgctgacaaaaaactgcaagccgttcagcagggttctgggatatctctgaacaggaaaggagttgatctgaaagaattaaactaaatatacacttaattacataagtcctgatctgtgaattttgttgaaattggtgatatggtttgtatctgtgtccccacccaaatctcatacagaaatgtgatgctggaggtggggcttggtgggaggtcactggatcatgagggcaatttctaacagtttagtaccatccccctggtgctgttctcatgacagagttcttatgagacctggytgtttaaaagtgtgtggcactccccccagcccccttcctcctgctccagccatgtgaagatacctgctccagctctgcctcccaccatgagtaaaagctccctgaggcccccccagaagcagatgctaccaggcttcctgtatagcctgtggaaccattagccaattaaacctcttttcgtataaattacccagtttcaggcattttatagcagtgcaagaatggactaaaaaaactgggaagacaaaagggaacaatattccctgaaaccccatttcagtcttttctcagcacttctgc

SEQ ID NO: 77882 - DNA, 601 bp, Human
ctcctgggttcaagcaattctcctgcctcagcctccagagtagctggaattacaggcatgcagcaccacacccggctaattttatatttttagtagagacggggtttctccatgttgaggctggtctcgaactcctgacctcaggtgatcagcccacctcggcctcccaaagtgctgggattacaggcgcgagccaccgtgcccagccacgatgtcctttcaaaatagatacaaatgaacattacactgaaaaaaatggatttattcataggctaattacagcataataaatgagctatayggtaagactctttttgtgttaactgctcattggtggcccaccatcctagaactgtatttccaggattccatcagcatctgcttaatgagatctatttctctgctaagtattctttagataagtaaatcagactttatcaaaaacagaactcatattattgcaagccataatagctagtttgtgatttgtaagaccatgttattgatatcacaaattaaaaagagatgtcccatttagaaaaagagatccctttacccaaccatcatactctaaaaataaaaccaacatttcttcacacac

SEQ ID NO: 77883 - DNA, 601 bp, Human
ttttagtagaaacggagtttcaccatgttggccaggctggtcttgaactcctgacgtcaggtgatccgcccaccttggcctcccaaagtgctgggattacaggcgtgagccaccgcgcccggccgcattttaggctttaaaaggatacaggaaactagtactgcaagcttagccgtgccattactgaactgattaaaatttttgacacaaattgtaaatcaggcaaaatgcaacttcaaaagttcaaatattatgaaaaatatttactgttactatgaatctatttcaagaccaatgaagkctgaagtaagacctaactgttgccttgccaaatccatttctcaatataaatgccatgtaaaattacacaatagatttactctaaccctttttacatgggagttacaaaacgaagcctttaaacccctctagggataaatttacttttctcagccaagtgttaacagcaataaatggaggatttacatgtaatccctaaaagcaaataggcagaaattaccaaccatgctatgactttttaactaagcattttatttaatctcacttgcataacagggcaatttaaagggtgccagttcta

SEQ ID NO: 77884 - DNA, 601 bp, Human
ccaccacgcccaactaatttttgtattttttagtagaaacggagtttcaccatgttggccaggctggtcttgaactcctgacgtcaggtgatccgcccaccttggcctcccaaagtgctgggattacaggcgtgagccaccgcgcccggccgcattttaggctttaaaaggatacaggaaactagtactgcaagcttagccgtgccattactgaactgattaaaatttttgacacaaattgtaaatcaggcaaaatgcaacttcaaaagttcaaatattatgaaaaatatttactgttacyatgaatctatttcaagaccaatgaaggctgaagtaagacctaactgttgccttgccaaatccatttctcaatataaatgccatgtaaaattacacaatagatttactctaaccctttttacatgggagttacaaaacgaagcctttaaacccctctagggataaatttacttttctcagccaagtgttaacagcaataaatggaggatttacatgtaatccctaaaagcaaataggcagaaattaccaaccatgctatgactttttaactaagcattttatttaatctcacttgcataac

SEQ ID NO: 77885 - DNA, 601 bp, Human
ggttcaagcgattctcatgcctcagcctcccgagtagctgggattacaggcatgcgccaccacgcccaactaatttttgtattttttagtagaaacggagtttcaccatgttggccaggctggtcttgaactcctgacgtcaggtgatccgcccaccttggcctcccaaagtgctgggattacaggcgtgagccaccgcgcccggccgcattttaggctttaaaaggatacaggaaactagtactgcaagcttagccgtgccattactgaactgattaaaatttttgacacaaattgtaartcaggcaaaatgcaacttcaaaagttcaaatattatgaaaaatatttactgttactatgaatctatttcaagaccaatgaaggctgaagtaagacctaactgttgccttgccaaatccatttctcaatataaatgccatgtaaaattacacaatagatttactctaaccctttttacatgggagttacaaaacgaagcctttaaacccctctagggataaatttacttttctcagccaagtgttaacagcaataaatggaggatttacatgtaatccctaaaagcaaataggcagaaatt

SEQ ID NO: 77886 - DNA, 601 bp, Human
caactgcctatttcactttgggtttcttttgagcaacctaccactattttcagaatcacccttccagcctacttgtgtcacagataggaaggtctttccctggcattttaggctttttattttttttttttgagacagagcctcgttctgttgcccgggctggagtacagtggagcaatcttggctcgctgcaacctccgcctcctgggttcaagcgattctcatgcctcagcctcccgagtagctgggattacaggcatgcgccaccacgcccaactaatttttgtattttttagtagaracggagtttcaccatgttggccaggctggtcttgaactcctgacgtcaggtgatccgcccaccttggcctcccaaagtgctgggattacaggcgtgagccaccgcgcccggccgcattttaggctttaaaaggatacaggaaactagtactgcaagcttagccgtgccattactgaactgattaaaatttttgacacaaattgtaaatcaggcaaaatgcaacttcaaaagttcaaatattatgaaaaatatttactgttactatgaatctatttcaagaccaatgaaggctgaagtaag

SEQ ID NO: 77887 - DNA, 601 bp, Human
atgtttggcaagctcctggaatctgtttatccaactgcctatttcactttgggtttcttttgagcaacctaccactattttcagaatcacccttccagcctacttgtgtcacagataggaaggtctttccctggcattttaggctttttattttttttttttgagacagagcctcgttctgttgcccgggctggagtacagtggagcaatcttggctcgctgcaacctccgcctcctgggttcaagcgattctcatgcctcagcctcccgagtagctgggattacaggcatgcgccaccaygcccaactaatttttgtattttttagtagaaacggagtttcaccatgttggccaggctggtcttgaactcctgacgtcaggtgatccgcccaccttggcctcccaaagtgctgggattacaggcgtgagccaccgcgcccggccgcattttaggctttaaaaggatacaggaaactagtactgcaagcttagccgtgccattactgaactgattaaaatttttgacacaaattgtaaatcaggcaaaatgcaacttcaaaagttcaaatattatgaaaaatatttactgttactatgaat

SEQ ID NO: 77888 - DNA, 601 bp, Human
ggaaaaacaggtaacatatgacaattctaaggaggtcaccattttttaggaattagtatcactgataatagcaaactcatagagaccaggtcttgccaagactgcatgtgatataaaatgcttggtaaaatgtttggcaagctcctggaatctgtttatccaactgcctatttcactttgggtttcttttgagcaacctaccactattttcagaatcacccttccagcctacttgtgtcacagataggaaggtctttccctggcattttaggctttttattttttttttttgagacagagyctcgttctgttgcccgggctggagtacagtggagcaatcttggctcgctgcaacctccgcctcctgggttcaagcgattctcatgcctcagcctcccgagtagctgggattacaggcatgcgccaccacgcccaactaatttttgtattttttagtagaaacggagtttcaccatgttggccaggctggtcttgaactcctgacgtcaggtgatccgcccaccttggcctcccaaagtgctgggattacaggcgtgagccaccgcgcccggccgcattttaggctttaaaaggatacagg

SEQ ID NO: 77889 - DNA, 601 bp, Human
tcagcctctcaaagtcctagaattaccatcatgagtcatcctgcccactgtatcttgaagaacacctgccacaggaaagcactccacaaatccttgctgaatgaatgaatattgtttcatcttacccaacatacagcattatggttattttaaacctaaaactccaatcaaaatcatatttcacttttataagataatactttctgtaacatttcacatattttcatggtctaatgaaattttccaatgctctaaatagcatccctatgccctctattttttttttcaccacaacaaatawttaaaacaaaatctgtctccaagtttaactctgctctatacccactccaatatttcattagagtatctttggaccaaagagaacaaggtaacaattttagattaagtggtatgccaactacaaattgatgtactgcttcagtgaaacatacatgaagaaaaatggaagctattctatacttaacgaaaaacttcaagtcctgctaataaaacaaaaatatctcaggcaggagaaaaaaaaaagtgacttatgttattggaaaaacaggtaacatatgacaattctaaggaggtcaccatt

SEQ ID NO: 77890 - DNA, 601 bp, Human
atttttattttgtaaagacaaggtctcactatattgcccagtctggcctcaaactcctgggctcaaggaatcctcccacctcagcctctcaaagtcctagaattaccatcatgagtcatcctgcccactgtatcttgaagaacacctgccacaggaaagcactccacaaatccttgctgaatgaatgaatattgtttcatcttacccaacatacagcattatggttattttaaacctaaaactccaatcaaaatcatatttcacttttataagataatactttctgtaacatttcacataytttcatggtctaatgaaattttccaatgctctaaatagcatccctatgccctctattttttttttcaccacaacaaatatttaaaacaaaatctgtctccaagtttaactctgctctatacccactccaatatttcattagagtatctttggaccaaagagaacaaggtaacaattttagattaagtggtatgccaactacaaattgatgtactgcttcagtgaaacatacatgaagaaaaatggaagctattctatacttaacgaaaaacttcaagtcctgctaataaaacaaaaatat

SEQ ID NO: 77891 - DNA, 601 bp, Human
acgaataccgagaaagtaaagttaaatttcttatcattagggacataaaacagagataggcatgaaaacaaaaaattgcagtatgatacaacagtgataatagaaatactaaagaggagtaacactaacccctctaaaaagagagagtagtcaactctgcatcggacagagtcatcaaggaaggttctaagaaaggaagacaatgcttggccatgattttaaaggatgagtgagaaaaaaaaaaaatcccccaagtggacagaagcagcaggtaaggaatttgattccagaagaagagcaytgaatataaagaagtgtcacccaaaacagcatggtcagcacaaagaaatacatgtaggtcaccatagtgataaacagacagtgccctttaaccactctctaaccccccatcctctgctcctccagatgctgcaaaaaaggacagaggaaatataaagcctgccactctcttgagttgcacttcccaaagaggtccactcctttaacctcctcttcaaacggagaattggaaagggactaggcaggctcccttgtcaatgaggagaagcagtggtgtagtgacactctccaaaacagcttc

SEQ ID NO: 77892 - DNA, 601 bp, Human
ggtgtttgctatgtttgctaatcttatatacattatttcatttaatctctccaaaattcaaagccgtctgtatgtaggacgaagattcaaacacagctcttaacccaaagctcttagtcaatattctattgtcttagacaatattcactgtccatgggtttgacacctggcagaaagatccaatatagaaatatatatttgcaagtttatctttcgttcactcattcattcagcagaaatttattaggtacctaaggttggatctacgaataccgagaaagtaaagttaaatttcttatcmttagggacataaaacagagataggcatgaaaacaaaaaattgcagtatgatacaacagtgataatagaaatactaaagaggagtaacactaacccctctaaaaagagagagtagtcaactctgcatcggacagagtcatcaaggaaggttctaagaaaggaagacaatgcttggccatgattttaaaggatgagtgagaaaaaaaaaaaatcccccaagtggacagaagcagcaggtaaggaatttgattccagaagaagagcattgaatataaagaagtgtcacccaaaacagcatggt

SEQ ID NO: 77893 - DNA, 601 bp, Human
atggtcactcttacgctctactgggctacacttctacacaataatttgaaaagctggtcatttaaagccatttaaaactctatattctttgacttggaaattctatcggtttcagtgagtggataaactagttttgctaaccaaaagaaaataattcaattttaggaaaatggtaactttggtttaatagtataaatttcagactcctacaagatatccaaagggaattgtctagtaggcagttggacatatataacaattagcatttactcatggtgtttgctatgtttgctaatcttayatacattatttcatttaatctctccaaaattcaaagccgtctgtatgtaggacgaagattcaaacacagctcttaacccaaagctcttagtcaatattctattgtcttagacaatattcactgtccatgggtttgacacctggcagaaagatccaatatagaaatatatatttgcaagtttatctttcgttcactcattcattcagcagaaatttattaggtacctaaggttggatctacgaataccgagaaagtaaagttaaatttcttatcattagggacataaaacagagataggca

SEQ ID NO: 77894 - DNA, 601 bp, Human
ccaatagaacaataataattcaaatactacaaatctaaatcctccgggattcaatctcctgtacactgaagtttcaattcaacaaacatgcattaagtgatgtgcgaagaacaagaaattaggtgaggtgctgggaaagcagtgtgaatgagcctttaaagagcttgcactctgttagaagagaggtttaagccaatgattacaacacagtgtggtacttcaatatcacaagtatgtgtaccctcacaaataaatatgaaaacacctcataacaggcatataaacataataggcaactcayaaaagaatacaaatggtcaacagatcaaacccattgtttgcctgtgcagtgtatattcaaaagctcttaatatctcctgttggcgggaggtgtgggaaaatggtcactcttacgctctactgggctacacttctacacaataatttgaaaagctggtcatttaaagccatttaaaactctatattctttgacttggaaattctatcggtttcagtgagtggataaactagttttgctaaccaaaagaaaataattcaattttaggaaaatggtaactttggtttaatagtataaatttca

SEQ ID NO: 77895 - DNA, 601 bp, Human
aaacagaaaagactatcgattcctatcttctcaacaagacttagcataaacaaccttacatgtgacattcaattcaaagatttgttactagatactcagagggtaactattccattttcatacatataagtttactaagttatgatgctaagcaggtaggccataatgcccagacaactgcagataacactagatgaacagcaactactaaattacaacataacctggtgttgttcaacctattcttgtattcatgagaactgctactgaaattcaatgacctgtgaatgtctgatgtaamagaagcctggctcccccaataaaaatccccaatagaacaataataattcaaatactacaaatctaaatcctccgggattcaatctcctgtacactgaagtttcaattcaacaaacatgcattaagtgatgtgcgaagaacaagaaattaggtgaggtgctgggaaagcagtgtgaatgagcctttaaagagcttgcactctgttagaagagaggtttaagccaatgattacaacacagtgtggtacttcaatatcacaagtatgtgtaccctcacaaataaatatgaaaacacctcataa

SEQ ID NO: 77896 - DNA, 601 bp, Human
ttgtgagcagggaaatgattaagcattacagtatttactttattgttgccctcactactgacaaatgccaaagtaatgtggcaaggacggaggaagagggtattcaatacacagcttcaacaccagtatttacgctgagaatactcaccactgcctcgtggttgtttccttccctggcataagtatgtattgaaagtctcaaaatcagtccttatctggaaacttttctcagacaaaaccagtagcaacaatgtataaacaggatatagatttataaaaattcaccaaaatctgaaagacraagaaatgggccaagatccccaaggcccatttacaacatccttgcaaagctcagaaaacgaaaattcaagccaaggatccttccatccacctctaaataactccacatcctcattccaatgcatgctggttctgtgagctaaggtccctgttaagcttttgtttactcatttatgaaatggaaataataacaataataccttctttatagagttgttgtgaaggttacatggaataatccatgcaagtacctagcaaagtgctcagcaaatatcaatattcaaaaaagtattggctataa

SEQ ID NO: 77897 - DNA, 601 bp, Human
ctagctaggataatcaaagagtagcaagtaggagatcagtgaactagaaggataaaggaaaagagagaccagggcagtgagaccaggaagaaacaggaaacgagctgtgtagagcatactgtgcattctgttttatagctgccctgtaaattccaaaaaataacacacccttttggaaggcaaaatgaattttaaaaagataaaacctcagaggcaggttaaatatactttttagtaaacgtcacctcatttagaaacactacatttacaaccttgagagcagatgcggtattattaggtrcttatggtgcttaactgggccagagggaagattttctctatgcttaaattttataagtaggaggacaaggaaagggagagacagaaggggtaggggaggagggagacagagtgggagggggaagggagggaagcatttctttgataacatttctcaaggttaaagtaccaaagacataccaaagcgccaacagaactaagtctcagggttatgaatgctgaatgaaatgaaggacattaaagatttgttactaaataaataagtaaataattttttaaaagaaaagaaaaaacaatttgt

SEQ ID NO: 77898 - DNA, 601 bp, Human
ctacgagtctatggattaattcaatcaaaaagatccattattaagcaaattaaaaacacacacatacgcatagacacacacacactctctctctctctctataggactaaataaatgagtgctccagaatggcagaactgcacagccagatgatacattcagagtccagtggcttcattttcttatgaggaaatgactacattctgaagggagagacaggtcttaggcatctttccatccccgcagcttgcatagtgcctgggccatagcagtcatttttaaacgtctcataagctgaggytgtgacactcctaacaccagaacccaagagccttagagcctatgatcgtttcaccatatcatgaggtgtcttgacttcttgcaggagagaaagaaaaaaaaaaagcccaaaataagtggagtatgaacagaataaagatgacaggacagaacatcaagttatttttcagaagagtgaacaacggagttctggaaaagtccactgaagaatctagtctaggaaagtaagatgagattaatgaaataatcttgttggcgtggtttataaaacataaaacaatggagtgactaagaaatctca

SEQ ID NO: 77899 - DNA, 601 bp, Human
actttaaacgtcttcttatttgtaaatcctacgagtctatggattaattcaatcaaaaagatccattattaagcaaattaaaaacacacacatacgcatagacacacacacactctctctctctctctataggactaaataaatgagtgctccagaatggcagaactgcacagccagatgatacattcagagtccagtggcttcattttcttatgaggaaatgactacattctgaagggagagacaggtcttaggcatctttccatccccgcagcttgcatagtgcctgggccatagcagkcatttttaaacgtctcataagctgaggctgtgacactcctaacaccagaacccaagagccttagagcctatgatcgtttcaccatatcatgaggtgtcttgacttcttgcaggagagaaagaaaaaaaaaaagcccaaaataagtggagtatgaacagaataaagatgacaggacagaacatcaagttatttttcagaagagtgaacaacggagttctggaaaagtccactgaagaatctagtctaggaaagtaagatgagattaatgaaataatcttgttggcgtggtttataaaacat

SEQ ID NO: 77900 - DNA, 601 bp, Human
atagctcaggcaaaagtcttagaatcaagaaatttttaaacggtcaacttggacagaaaagtgctgaattagaaatcgaagatctgggttctttcccagctttgccactaattgtgtgacaggagggcagtcactttactgccaaggcctgttacctcacctgtaaaacagatgattaaatcatattaactttaaacgtcttcttatttgtaaatcctacgagtctatggattaattcaatcaaaaagatccattattaagcaaattaaaaacacacacatacgcatagacacacacacaatctctctctctctctataggactaaataaatgagtgctccagaatggcagaactgcacagccagatgatacattcagagtccagtggcttcattttcttatgaggaaatgactacattctgaagggagagacaggtcttaggcatctttccatccccgcagcttgcatagtgcctgggccatagcagtcatttttaaacgtctcataagctgaggctgtgacactcctaacaccagaacccaagagccttagagcctatgatcgtttcaccatatcatgaggtgtcttgacttcttgcag

SEQ ID NO: 77901 - DNA, 601 bp, Human
catatgctccaaaaagcaaaaaccagaccagtatgtaggaggcatctgactgatagtcagtgacttaacctgcaaaacgctacagcgatcattaccaataccagtgggatacttccagatttctgtatgaaaccaggaatcatagctcaggcaaaagtcttagaatcaagaaatttttaaacggtcaacttggacagaaaagtgctgaattagaaatcgaagatctgggttctttcccagctttgccactaattgtgtgacaggagggcagtcactttactgccaaggcctgttacctcayctgtaaaacagatgattaaatcatattaactttaaacgtcttcttatttgtaaatcctacgagtctatggattaattcaatcaaaaagatccattattaagcaaattaaaaacacacacatacgcatagacacacacacactctctctctctctctataggactaaataaatgagtgctccagaatggcagaactgcacagccagatgatacattcagagtccagtggcttcattttcttatgaggaaatgactacattctgaagggagagacaggtcttaggcatctttccatccccgc

SEQ ID NO: 77902 - DNA, 601 bp, Human
ttctttcatatgctccaaaaagcaaaaaccagaccagtatgtaggaggcatctgactgatagtcagtgacttaacctgcaaaacgctacagcgatcattaccaataccagtgggatacttccagatttctgtatgaaaccaggaatcatagctcaggcaaaagtcttagaatcaagaaatttttaaacggtcaacttggacagaaaagtgctgaattagaaatcgaagatctgggttctttcccagctttgccactaattgtgtgacaggagggcagtcactttactgccaaggcctgttwcctcacctgtaaaacagatgattaaatcatattaactttaaacgtcttcttatttgtaaatcctacgagtctatggattaattcaatcaaaaagatccattattaagcaaattaaaaacacacacatacgcatagacacacacacactctctctctctctctataggactaaataaatgagtgctccagaatggcagaactgcacagccagatgatacattcagagtccagtggcttcattttcttatgaggaaatgactacattctgaagggagagacaggtcttaggcatctttccat

SEQ ID NO: 77903 - DNA, 601 bp, Human
tccattctctcctcctttttataagatgttattgcagcaaccctgtcttctctcccccgttgtgtgccaatgtgttgcaatggctggcttaactttcagaccataggttgacggaaaagagagacatcccctcatttgctggacttgaagctagaagcaggtactgctgacaagatttacatacctccctttggggaaggggcacatgtgctttatctatgtttgccctcgtcaacaatcaatgacctgaccctaactcctcccttctttggtgtccgaaacaatcaacctcaccaatatstctgaaattcaactatttatatttccatccctactttcacttccctggctcaattcttacatgaaatcgctgcaacagcctcctaattaacttatctccagttgcctccttccaattagttctccttgaaaccactgaagttctcttccaaaacagacaaacccaaacatgtaactacctgacctaaaatccatttttggttctctaaaccctttaaacaaaaaccaggtgcctcagaatgtcgtacgacgccatccattttccagcttccactgtgcaatttccatagcctcttcttga

SEQ ID NO: 77904 - DNA, 601 bp, Human
cacagcatctatggaatatgtccattctctcctcctttttataagatgttattgcagcaaccctgtcttctctcccccgttgtgtgccaatgtgttgcaatggctggcttaactttcagaccataggttgacggaaaagagagacatcccctcatttgctggacttgaagctagaagcaggtactgctgacaagatttacatacctccctttggggaaggggcacatgtgctttatctatgtttgccctcgtcaacaatcaatgacctgaccctaactcctcccttctttggtgtccgaamcaatcaacctcaccaatatctctgaaattcaactatttatatttccatccctactttcacttccctggctcaattcttacatgaaatcgctgcaacagcctcctaattaacttatctccagttgcctccttccaattagttctccttgaaaccactgaagttctcttccaaaacagacaaacccaaacatgtaactacctgacctaaaatccatttttggttctctaaaccctttaaacaaaaaccaggtgcctcagaatgtcgtacgacgccatccattttccagcttccactgtgcaa

SEQ ID NO: 77905 - DNA, 601 bp, Human
ttcagatctctgagacatccaggaatccctcctccctgaaccgcttccttggattcagagacaccacactctcccagatttccctcaccccaaccctcctgctctctagttgcttcttctaagaggggccactttcttcactcatcccttaaatgccagtgttccctaggatcttgtgcctctttcttgactcacctctcagatgctgctgtgcctctggattctgtccctatttaattatcatgcaccccctctgggtattaccaatcaatagcttcatcttctgcttccataaattgayagctccactttactaagatcagtaaagtgctaagaacagagactggcacatggcaaagctcagtacatgttagctatctttactgtaatttccctgagcttcactctgcatgtttaatggccaattggacatctgtacctattgtatgtttaatggcctattgacaagcctatgttcctgtctatatttaatatcaatatttctaaaactcatatccaaaactgaattcaatgtcctcttccccaccaaaacacaaacaaaaaaatttaaaaaccggttcctccttcagcattttattct

SEQ ID NO: 77906 - DNA, 601 bp, Human
ccttgataaattttaagagcgtaaagaagtcttgataacaaaaagctaagaaatgccaacaggctgaatcactgagggagctatgtgcttctgtatcagtcatgtaactctatggagttactgaaaatctgagttccaaattttactaccttacaggagactgtacaaatatgcctctcctcctaaaccatccaacttccctacctagcctttcccagatttgcaagccagttttgcttcagcaagaatcaaatgtctagtcaagatactttgctgactactcttcacttcactgaaagcrtaactattagctttgatggaggaggctagttataaaacaaaaacctacagaaaactatttctgtaaatttttccaatgctatcataattcattcatattttttaagcagattatcaaatgagataacatcttaggcttcagagtatataataacaattatgagaaactattctcaaataaccaagtcagtttattttttaaattattttcataaaatatattttctttcaaatgtgacaaagagaagagtacttgtttttaagtacttagtctatattacctggctccattatctatgag

SEQ ID NO: 77907 - DNA, 601 bp, Human
cttcgtgaaaaggaagtgaaggcctgactcacttgatggttccttcccctggaattttatagaggaaatttaaatcagtaaacacatttgaggagtcaacataaagaatattttaccaggccccaaggggcagaagaaaggaaaccaagggaatggtcatcaagaaatacatatagtttcatccagtggttctcaaagtgtagtccagggaccccctcccacccaactcctgccaagaggtccctgaaatcctctcaggagttcaggagttcaaaaatgttttcttaatactactaaaatrtaagttgtcttttttactctcattctctcatgacttacagtgaaatattccaaatgacagactgaatgcagaagcacatttgtgaatctagctgtctttaatcaagccagatgttaatgagattgacaaaaatgcacagcaatgatattttttcatgattttgtaaaatattatttttcataaatatatgctctttataatgaatttatttttggtatttttcatgaatttatatttttaattttatcacttttaatttgtaacatggctaatattaagtttcttggggtccttgataaa

SEQ ID NO: 77908 - DNA, 601 bp, Human; identical to SEQ ID NO: 31863

SEQ ID NO: 77909 - DNA, 601 bp, Human; identical to SEQ ID NO: 31864

SEQ ID NO: 77910 - DNA, 601 bp, Human; identical to SEQ ID NO: 31865

SEQ ID NO: 77911 - DNA, 601 bp, Human; identical to SEQ ID NO: 31866

SEQ ID NO: 77912 - DNA, 601 bp, Human; identical to SEQ ID NO: 31867

SEQ ID NO: 77913 - DNA, 601 bp, Human; identical to SEQ ID NO: 31868

SEQ ID NO: 77914 - DNA, 601 bp, Human; identical to SEQ ID NO: 31869

SEQ ID NO: 77915 - DNA, 601 bp, Human; identical to SEQ ID NO: 31870

SEQ ID NO: 77916 - DNA, 601 bp, Human; identical to SEQ ID NO: 39805

SEQ ID NO: 77917 - DNA, 601 bp, Human; identical to SEQ ID NO: 39806

SEQ ID NO: 77918 - DNA, 601 bp, Human; identical to SEQ ID NO: 39807

SEQ ID NO: 77919 - DNA, 601 bp, Human; identical to SEQ ID NO: 39808

SEQ ID NO: 77920 - DNA, 601 bp, Human; identical to SEQ ID NO: 39809

SEQ ID NO: 77921 - DNA, 601 bp, Human
atttatttatttatttattgagtcagagacttgctctgtctcccaggctgaagtgcaatggcgcgattgcagctcactgcaacctccatctcctgggttcaagtgattctcctccctcagtctcccaagtagccgggattacaggcacccggcaccatgcccagttaatttttctatttttgtagagacagggtttcaccatgttggccgggctggtcttgaacttctgacctcagatgattggcccacctcagcctcccaaagtgctgggattacaggcatgagccaccacgcctggactttttttttttttttttttttaatggaaatgaggtctcattatgttgtccaggctggtcttgaactcctgggctcaagtggtcctctcacctcagcctcccaaagtgctgcgattacaggtatgagacacagccccagccctatttgtattatttattttgagacaaaataaatatatcttaggatgaactctgtcacccaggctggagggtagcgtcgcaatcatggctcacggcagcctccacctcccgggttcaagcgatcgtcccacctcagcctctggagtagctgggactctagg

SEQ ID NO: 77922 - DNA, 595 bp, Human
tttgagacagagtcctgctctatcatccaggctggagtggaatggcgcgatctcagctcactgcagcctccgcctcccaggttcaagcaattctcctgcctcagcctcccaggtcgctgggattgcaggcctgcaccaccatccctggctgatttttatattttttggtagggatggggtttcaccatgttggccaggctggtcgcaaactcctgagctcaactgacctaccagccacggcctcccaaaatgctgggatgacaggcgtgagccgtggcgcccagcctacattttttttatttatttatttatttatttatttatttatttattgagtcagagacttgctctgtctcccaggctgaagtgcaatggcgcgattgcagctcactgcaacctccatctcctgggttcaagtgattctcctccctcagtctcccaagtagccgggattacaggcacccggcaccatgcccagttaatttttctatttttgtagagacagggtttcaccatgttggccgggctggtcttgaacttctgacctcagatgattggcccacctcagcctcccaaagtgctgggattacaggca

SEQ ID NO: 77923 - DNA, 601 bp, Human
ttctttggagaaggagcctgactagaatatatcttgaaggaccgtttcagtctccacacctggggcttcttagggaatagactgaccctttaaatggaagaatggctcaaatgggaggtggctgtaaaaactcaattaactctttctagggttgccagatttagcaaatcaaatataggataccacttaaatttgaatttcagatgcacaacaaatttttattttttttttttagatgggttctctgtcacccaggctggagtgcagtggtgtgaacatggctcatgttcatgcatcctcyaccttccaggctcaagccatcctcccacctcaccctccagagtagctgggattacaggtgtgcgccaccagacccagctaactttttaattttttgtagaaacagagtcttgccatgttgcccaggctggtctccaactcctggactcaagcagtcctcttgccttggcatcccaaagtgctgggattacaggtgtgagctaccacacttgacccaaatacttttttagtatagatatgcctccaaatattgcttgggacttacttatactaaaaaaattattcatttgcatctgaaatt

SEQ ID NO: 77924 - DNA, 601 bp, Human
aggaggaagaaaggaaatggagaaggcccttcttcctcagctataccatcctgtgcctggcccctctccagtctcctctttctttggagaaggagcctgactagaatatatcttgaaggaccgtttcagtctccacacctggggcttcttagggaatagactgaccctttaaatggaagaatggctcaaatgggaggtggctgtaaaaactcaattaactctttctagggttgccagatttagcaaatcaaatataggataccacttaaatttgaatttcagatgcacaacaaatttttattttttttttttagatgggttctctgtcacccaggctggagtgcagtggtgtgaacatggctcatgttcatgcatcctctaccttccaggctcaagccatcctcccacctcaccctccagagtagctgggattacaggtgtgcgccaccagacccagctaactttttaattttttgtagaaacagagtcttgccatgttgcccaggctggtctccaactcctggactcaagcagtcctcttgccttggcatcccaaagtgctgggattacaggtgtgagctaccacacttgacccaaatac

SEQ ID NO: 77925 - DNA, 601 bp, Human
cagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagt

SEQ ID NO: 77926 - DNA, 601 bp, Human
ttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagcta

SEQ ID NO: 77927 - DNA, 601 bp, Human
cccttgtacctctctcctgatatccttaccttcagcctcctttgcttcctcttcttcttcatcttctaaatgaaacacgagaaatcaatcaaggtccttgttctgagctcaagtccccccctccgccaccagcaagagccttccccacagataagccctagccaagatgcactctgttggtttttggggttacagagctgtctctcacacacacattcccctggacccaagactgcctgacacaagagaagcgctgggtcaacgtttgttgattgggcaatcaatggttgaatcttagtcrataggagagtcaggtgcacatgggaaagcctgttctggggggtttcttactgcctcaggaatggctccaggggctctcgccaccccctgaggcccctgcaccctcaaccagagacttaccttctgccctggtctcctcggtctcagcctctgcttcagcatcctcttccgctgcctcctcctgctctggagaagtgaagcagacagagtgaagaagcaggccccactcatgctatcaggcagaacccagagcagagaatgggcagcggggagtggggatgggggtcaagacgtctaggtc

SEQ ID NO: 77928 - DNA, 601 bp, Human
ctgggtgccaccaatgcaacttctctgggagaaggggcaaagttgaaagctcaacatctaaaactttggaagtgccaccaagttctgtcctctcctctcccaaaccctctcagtgcacatccacttccctggaaagagcactgtgggcattctcctccaaagctgctgtgaggggttcctttgcctcccttgtacctctctcctgatatccttaccttcagcctcctttgcttcctcttcttcttcatcttctaaatgaaacacgagaaatcaatcaaggtccttgttctgagctcaagtycccccctccgccaccagcaagagccttccccacagataagccctagccaagatgcactctgttggtttttggggttacagagctgtctctcacacacacattcccctggacccaagactgcctgacacaagagaagcgctgggtcaacgtttgttgattgggcaatcaatggttgaatcttagtcgataggagagtcaggtgcacatgggaaagcctgttctggggggtttcttactgcctcaggaatggctccaggggctctcgccaccccctgaggcccctgcaccctcaaccagaga

SEQ ID NO: 77929 - DNA, 601 bp, Human
tggccctagaatcccctcccaggtctttgccttctttgttaccccttggacttcccggtggccacagggcagaagctgatgacatgattccaagccccagctggttgtcccctcccctttggagaagtgactgggaccacttagaaccctggtgaaggctgcagcatgacgatgactgcagcaatgacccaccatgaccatctatgcattgggatttcatcctacggacaccacatcctacaagtgatttcacctaagctctaggagcttcatgtgtggatatgacttctgggtcccattrctctgtccagaccagggggctggacaatggtcccctctcccactgggtgccaccaatgcaacttctctgggagaaggggcaaagttgaaagctcaacatctaaaactttggaagtgccaccaagttctgtcctctcctctcccaaaccctctcagtgcacatccacttccctggaaagagcactgtgggcattctcctccaaagctgctgtgaggggttcctttgcctcccttgtacctctctcctgatatccttaccttcagcctcctttgcttcctcttcttcttcatcttctaaatg

SEQ ID NO: 77930 - DNA, 601 bp, Human
atttccatttccccatctgcacagtgagtccctcccggcactggggagccctgattccagaagcatccaggagaatgaaggcagcgggggctgcagatgccacactccccctcccatagagttctgcagggcacacactcacgcagtgtggaacttcacacaaagccttctctcactcaccagttctgggcaaagcaattttgcttctcttgtgcttcacagtgacaaggcctttggaaaggtccccaagggtcctggccctagaatcccctcccaggtctttgccttctttgttaccccytggacttcccggtggccacagggcagaagctgatgacatgattccaagccccagctggttgtcccctcccctttggagaagtgactgggaccacttagaaccctggtgaaggctgcagcatgacgatgactgcagcaatgacccaccatgaccatctatgcattgggatttcatcctacggacaccacatcctacaagtgatttcacctaagctctaggagcttcatgtgtggatatgacttctgggtcccattgctctgtccagaccagggggctggacaatggtcccctctcccactg

SEQ ID NO: 77931 - DNA, 601 bp, Human
ctcagctctggcagtcaaggagcatccagtaggatggggagggaaggcagggacccgagaaaccagtcagggctgcaggagctgtgcagaatgctggagggcctctgaaggagacctcacacctagctgggtttgaggcgccgaggaaggctgtctggaggaggtggggcctcacaaaagggatggaggacagactgggccatcagagaatgttaggtgggcagactggacacctacgatcctgtctttgagagaaacgagctcctcctcctctttcttcctgttctcaaagtgagcctcratcagcgcctgcaactcattcaggtccttctccatgcgcttccggtggatgtcctgtgggtggaccgctgcggctcagaggctgccactccaaagagtccagaggagagatgggtgggctagacaccccccaacgcagtgcaaaagacctctggcagggcctggcgcctggccagggaaggggtaactgtggcctgaacccaggaccacgctcatggatgggcacccagcctggctggtgctgcaccccatcccacctatgctctaccccagcccaaggtcacaaaatctctgtcactga

SEQ ID NO: 77932 - DNA, 601 bp, Human
ctctggaaatgccttcagcagctgcacaggaagagagctacggggccttcggttcccacgaagtctgcactggggaagggatgagggctggagagtcttataaaataacacgttcataaggacgcaggcatttctgtcttgtttgctgatgtattatcagagccaagacaatgcccagcacttcctaggttgatattgatattgtctcttttttttcctttttttttttttttgagttggagtttcactcttgttgcccaggctagagtgcaatggcatgacctcggctcactgcaacctygcctcctgggttcaagcgattctcctgcctcagcctcctgagtagctaggatgaccggcatgtgccaccacgcctggctaattttgtatttttagtagagacagggtttctccgttggtcaggatggtctcgaactcccaacctcaagtgatctacccgccttggcctcccaaagtgctgggattacaggcgtgagccaccgcacccggccaatattgtctcttgactgatttcattcatgttgatgaatagagaggggcctgggggcccagcaggagctgggagcatggggggcctcca

SEQ ID NO: 77933 - DNA, 601 bp, Human
ggtcctgattcccaaatgtgaggtctcgtcatccccttaagctgggagtgcccctggaagacctgttgctctggaaatgccttcagcagctgcacaggaagagagctacggggccttcggttcccacgaagtctgcactggggaagggatgagggctggagagtcttataaaataacacgttcataaggacgcaggcatttctgtcttgtttgctgatgtattatcagagccaagacaatgcccagcacttcctaggttgatattgatattgtctcttttttttcctttttttttttttttgagttggagtttcactcttgttgcccaggctagagtgcaatggcatgacctcggctcactgcaaccttgcctcctgggttcaagcgattctcctgcctcagcctcctgagtagctaggatgaccggcatgtgccaccacgcctggctaattttgtatttttagtagagacagggtttctccgttggtcaggatggtctcgaactcccaacctcaagtgatctacccgccttggcctcccaaagtgctgggattacaggcgtgagccaccgcacccggccaatattgtctcttgactgatt

SEQ ID NO: 77934 - DNA, 601 bp, Human
cctgattctgggctgaagcttgtggtctttatgggtgagttcagctttctctccgctcagcaaggagctttctgagagggtagctcccagcacagtgctggcccacaggagtccactgactgagaaatgactgcgtgattgaatgaggtcctgattcccaaatgtgaggtctcgtcatccccttaagctgggagtgcccctggaagacctgttgctctggaaatgccttcagcagctgcacaggaagagagctacggggccttcggttcccacgaagtctgcactggggaagggatgaggkctggagagtcttataaaataacacgttcataaggacgcaggcatttctgtcttgtttgctgatgtattatcagagccaagacaatgcccagcacttcctaggttgatattgatattgtctcttttttttcctttttttttttttttgagttggagtttcactcttgttgcccaggctagagtgcaatggcatgacctcggctcactgcaaccttgcctcctgggttcaagcgattctcctgcctcagcctcctgagtagctaggatgaccggcatgtgccaccacgcctggctaattttg

SEQ ID NO: 77935 - DNA, 601 bp, Human
ctcctcctctcgtcgagccctctcttcctgatttacagcagggaggaagaaagcaaattaggggaaaggattggaaaccctgattctgggctgaagcttgtggtctttatgggtgagttcagctttctctccgctcagcaaggagctttctgagagggtagctcccagcacagtgctggcccacaggagtccactgactgagaaatgactgcgtgattgaatgaggtcctgattcccaaatgtgaggtctcgtcatccccttaagctgggagtgcccctggaagacctgttgctctggaawtgccttcagcagctgcacaggaagagagctacggggccttcggttcccacgaagtctgcactggggaagggatgagggctggagagtcttataaaataacacgttcataaggacgcaggcatttctgtcttgtttgctgatgtattatcagagccaagacaatgcccagcacttcctaggttgatattgatattgtctcttttttttcctttttttttttttttgagttggagtttcactcttgttgcccaggctagagtgcaatggcatgacctcggctcactgcaaccttgcctcctg

SEQ ID NO: 77936 - DNA, 601 bp, Human
atgccaaagtcttggctggtgtggtcaccatgggggcagaggcagggggtggcctagtcctgagctagggactaagctggaaatctaagaaaatgttttgattccttcactacctagagaaaatcaatttcacatatccctcctccctcgagaatggaggacctaggaggaatggggcacaaaagttagggatcgagagtgagtttccaggaacaaacaacctcacatctgtgtggcacatagacactttccatggtagctcatttgagcttctcaaagcatcaaggcaggcaatatgagygccagttgaggaaaccgaggctcagaggttgcaaaaggtcacacaactgtatgtggcagagctgggtctccaactagagctctgactctaggcacaaggctcttccagctgcacccagcctccttgggggctcctgagcactgctggagccaggcatggggggcaccattggtgccccaggctctgcctgtagccccctaccccagcaagcccctcctagtgcaagccgcggtcaggctgaaaaccagctcagggctgggcatgaggagacctcagtcttccacccacagcagctgggaa

SEQ ID NO: 77937 - DNA, 601 bp, Human
gtcagccgggtttactaggacgtgggtctgagggttacagcaggggctgttcggtagcatgaagactttgatgccaaagtcttggctggtgtggtcaccatgggggcagaggcagggggtggcctagtcctgagctagggactaagctggaaatctaagaaaatgttttgattccttcactacctagagaaaatcaatttcacatatccctcctccctcgagaatggaggacctaggaggaatggggcacaaaagttagggatcgagagtgagtttccaggaacaaacaacctcacatctrtgtggcacatagacactttccatggtagctcatttgagcttctcaaagcatcaaggcaggcaatatgagtgccagttgaggaaaccgaggctcagaggttgcaaaaggtcacacaactgtatgtggcagagctgggtctccaactagagctctgactctaggcacaaggctcttccagctgcacccagcctccttgggggctcctgagcactgctggagccaggcatggggggcaccattggtgccccaggctctgcctgtagccccctaccccagcaagcccctcctagtgcaagccgc

SEQ ID NO: 77938 - DNA, 601 bp, Human
cctaactaatctctttcacctctcaccagcttcccccctccccagccagcccaatctcttcactcctcccctccagcaaggcgccttcccctcccagggagctctccaaaactatggggaggaagaaggcttgaggtttttggtacccacctgggcctgctaaaccgggaaaccatgagagagaggcccatagaaaaagaccaagacggcaacagagacacagagagaaggcaggaagacaaaggcaaggagagacatggaagagaagattcagatactcgctgtagtcagccgggtttamtaggacgtgggtctgagggttacagcaggggctgttcggtagcatgaagactttgatgccaaagtcttggctggtgtggtcaccatgggggcagaggcagggggtggcctagtcctgagctagggactaagctggaaatctaagaaaatgttttgattccttcactacctagagaaaatcaatttcacatatccctcctccctcgagaatggaggacctaggaggaatggggcacaaaagttagggatcgagagtgagtttccaggaacaaacaacctcacatctgtgtggcacatagac

SEQ ID NO: 77939 - DNA, 601 bp, Human
aggttcttatgctcttcttcctgccacaccccccaactaccaactacatgtattccctagggaaactgaggtaggggcaagaaggatcacgtcagtctcttccttctttgcctaactaatctctttcacctctcaccagcttcccccctccccagccagcccaatctcttcactcctcccctccagcaaggcgccttcccctcccagggagctctccaaaactatggggaggaagaaggcttgaggtttttggtacccacctgggcctgctaaaccgggaaaccatgagagagaggcccakagaaaaagaccaagacggcaacagagacacagagagaaggcaggaagacaaaggcaaggagagacatggaagagaagattcagatactcgctgtagtcagccgggtttactaggacgtgggtctgagggttacagcaggggctgttcggtagcatgaagactttgatgccaaagtcttggctggtgtggtcaccatgggggcagaggcagggggtggcctagtcctgagctagggactaagctggaaatctaagaaaatgttttgattccttcactacctagagaaaatcaatttcacat

SEQ ID NO: 77940 - DNA, 601 bp, Human
cttcctcctctcagccagaatcttcttcttcttttcccgctcagtctgcctcttcccacttttccgctctgtctggagggtgtgggaagcagagtaaactggccagattgccccctccctgtcccctaaccctccccaaaccccctgggggtggagcaaggcctgcaggagggccaggttcttatgctcttcttcctgccacaccccccaactaccaactacatgtattccctagggaaactgaggtaggggcaagaaggatcacgtcagtctcttccttctttgcctaactaatctcttycacctctcaccagcttcccccctccccagccagcccaatctcttcactcctcccctccagcaaggcgccttcccctcccagggagctctccaaaactatggggaggaagaaggcttgaggtttttggtacccacctgggcctgctaaaccgggaaaccatgagagagaggcccatagaaaaagaccaagacggcaacagagacacagagagaaggcaggaagacaaaggcaaggagagacatggaagagaagattcagatactcgctgtagtcagccgggtttactaggacgtgggtctg

SEQ ID NO: 77941 - DNA, 601 bp, Human
agtcctgccctctggtggctcacagcaagaagtgcccttggcccgacccctcccagagcagatgcgggcagtgccccaggaccattcctcccagcccccacctcagctgatcttcattcaggtggtcaatggccagcaccttcctcctctcagccagaatcttcttcttcttttcccgctcagtctgcctcttcccacttttccgctctgtctggagggtgtgggaagcagagtaaactggccagattgccccctccctgtcccctaaccctccccaaaccccctgggggtggagcaaggyctgcaggagggccaggttcttatgctcttcttcctgccacaccccccaactaccaactacatgtattccctagggaaactgaggtaggggcaagaaggatcacgtcagtctcttccttctttgcctaactaatctctttcacctctcaccagcttcccccctccccagccagcccaatctcttcactcctcccctccagcaaggcgccttcccctcccagggagctctccaaaactatggggaggaagaaggcttgaggtttttggtacccacctgggcctgctaaaccgggaaaccatg

SEQ ID NO: 77942 - DNA, 601 bp, Human
cctgggaccggggctcgggggtggtgggtaaggaaggactggcgcccaggtctaagctccggtatgcagcatcagtgtcctctaagccatttccttgcctggtgtctgttcacctaagaccctcattagtgcacataggactccgaaagactgtgagcttgaggctcagcctaattgtgcccacaccaggaccttgggtgtatgtggggagaagcacctctctgttggcagcactccccttccactgggggtcctggcttggtgcatcctggtccttgtaaccagctcagatcactgagcygctgcctcaacgtgttggagacccccagggttggaacaccaggaaagtgtctctgctcagccccagcgagctctcagacacttccagcaagcagtcgtcaatgcggtggacatggaacactgctgaaggccaggcagcaggggcagatgcaggagctgaagggggctgttggggaatagggacagggacccagggacctgcagcagtattaccggacccagtgaaccaggaggagtgtgagatggagatgctgggcggggacagcatggcggcccacctcatatttctgctgcttgaact

SEQ ID NO: 77943 - DNA, 601 bp, Human
ctgagcctgcccagcgaggggcttcttgcccagggaggagtggtttggcaggagcagcaaaggagaccttccaggggaagctgaattcttcccttaggtagcaaagaggccctgggaccggggctcgggggtggtgggtaaggaaggactggcgcccaggtctaagctccggtatgcagcatcagtgtcctctaagccatttccttgcctggtgtctgttcacctaagaccctcattagtgcacataggactccgaaagactgtgagcttgaggctcagcctaattgtgcccacaccaggrccttgggtgtatgtggggagaagcacctctctgttggcagcactccccttccactgggggtcctggcttggtgcatcctggtccttgtaaccagctcagatcactgagctgctgcctcaacgtgttggagacccccagggttggaacaccaggaaagtgtctctgctcagccccagcgagctctcagacacttccagcaagcagtcgtcaatgcggtggacatggaacactgctgaaggccaggcagcaggggcagatgcaggagctgaagggggctgttggggaatagggacagggacc

SEQ ID NO: 77944 - DNA, 601 bp, Human; identical to SEQ ID NO: 21037

SEQ ID NO: 77945 - DNA, 601 bp, Human; identical to SEQ ID NO: 21038

SEQ ID NO: 77946 - DNA, 601 bp, Human; identical to SEQ ID NO: 21039

SEQ ID NO: 77947 - DNA, 601 bp, Human; identical to SEQ ID NO: 21040

SEQ ID NO: 77948 - DNA, 601 bp, Human; identical to SEQ ID NO: 21041

SEQ ID NO: 77949 - DNA, 601 bp, Human; identical to SEQ ID NO: 21042

SEQ ID NO: 77950 - DNA, 601 bp, Human; identical to SEQ ID NO: 21043

SEQ ID NO: 77951 - DNA, 601 bp, Human
gctctgtctgtgcttggctgggagggaaggagtgggattcttaggcttagggaaaggtcagtgaaaggagagtgagaggtgtttgaaaggtgaaatgacattccgtctagcttctttcatactatctctttacccatagttaattttatgaaaattgtacatttacagtattattaaaagttaaaaaaaattagcactataaggcagtggttcttaaccaaaggcagttttgccctgcagggtcatttggcaatggtcagaaacatttttggttgtcacagttggggaaaagggggattgstactgacatctaatgggtagaggccagaaacactgatagacaatgcataggacagccccacacaacaaagaattatatggcccaaaatgttggtagtgctgatgttgagagaccctactataaggcttacaataaataaatagtgcagcctgggaaacatagggagaccaccatttctactaaaataaaaataaattaaaaattagccaggcatggtggcacatgcctgtggtcccagctgcatgggaggctgaagtgggaggattgcttgagcccaagaagtccaggctgtagtgagct

SEQ ID NO: 77952 - DNA, 601 bp, Human
gaaatgacattccgtctagcttctttcatactatctctttacccatagttaattttatgaaaattgtacatttacagtattattaaaagttaaaaaaaattagcactataaggcagtggttcttaaccaaaggcagttttgccctgcagggtcatttggcaatggtcagaaacatttttggttgtcacagttggggaaaagggggattgctactgacatctaatgggtagaggccagaaacactgatagacaatgcataggacagccccacacaacaaagaattatatggcccaaaatgtkggtagtgctgatgttgagagaccctactataaggcttacaataaataaatagtgcagcctgggaaacatagggagaccaccatttctactaaaataaaaataaattaaaaattagccaggcatggtggcacatgcctgtggtcccagctgcatgggaggctgaagtgggaggattgcttgagcccaagaagtccaggctgtagtgagctgtaatcacaccactgcactgcagtcttgcagcagagcaagaccctgtctcaaaaaagaagaaaaagaaaaatagcagtcgccagccccacc

SEQ ID NO: 77953 - DNA, 601 bp, Human
ttcatactatctctttacccatagttaattttatgaaaattgtacatttacagtattattaaaagttaaaaaaaattagcactataaggcagtggttcttaaccaaaggcagttttgccctgcagggtcatttggcaatggtcagaaacatttttggttgtcacagttggggaaaagggggattgctactgacatctaatgggtagaggccagaaacactgatagacaatgcataggacagccccacacaacaaagaattatatggcccaaaatgttggtagtgctgatgttgagagaccctactataaggcttacaataaataaatagtgcagcctgggaaacatagggagaccaccatttctactaaaataaaaataaattaaaaattagccaggcatggtggcacatgcctgtggtcccagctgcatgggaggctgaagtgggaggattgcttgagcccaagaagtccaggctgtagtgagctgtaatcacaccactgcactgcagtcttgcagcagagcaagaccctgtctcaaaaaagaagaaaaagaaaaatagcagtcgccagccccacctttcctcaatttccactcctcagt

SEQ ID NO: 77954 - DNA, 601 bp, Human
ctgcatctctgagagatctgcctttaagcttgattaatagtttatgtagatttgcatttctattttagaaactatttttccttggaattttgaagatattcctccagtgacttctaggttctgtagctgttgttgaaaggtatgaagccattctaattactaaaactttgaataagactttttaaaaacaaaaatctggaaggttttaggttgttttctttattcccaacattctgaaattttatggtgttgtgccttagtgtgtgtgagcaaagggttagtaaactccttctcctgtctkctgtgaaaatggcctcctggtgatcttccagcactctctctgcaatctatgaaaggtggaatgacagctgtgtgaccttacagcattgcctgtggtaaacataacccttgattggtaaagtgcatctgagctgggaggattgtgaatgaactataaatacttgaggagaagccatagctttgggctttcctgaatgtggtgtgacatacccaggtgttcttcttgttgagtcctggaaggacagcagtactctcgtaccaatcctgcataggttcaaaatatattgtattttatatgtgg

SEQ ID NO: 77955 - DNA, 601 bp, Human
tgatgtctgggtagggacagatccacttatgattggatggcagaagctgtgtggctattgaggtgcctagggtgaaaattttaaggaagtcctcactcttagggctgtacctgcacttgtatattcctgagagtgcctccttaaattttctctaggcaccttatttgcctcaccctagtcctgcatctgagttgcacctgagaaggacgattctagttagagcagatgaaagctgaaatgagtaaatttggttgaaagaaaaagtgtttataaaaagataggggaaaaaagacaaaagacragatgagaaatgctggctagggtttggagaagagggaaccctggaacactgttggtaggaaggtagattggtgcagccattatggaaaacagtatggaggtttctatctttaaatagaaattaaaaatagaactgctggtcaggcacagtggctcatgcctgtaatcccagcgctttgggaggccgaggcgggcagatcacctgaggtcaggagttcgagaccagattggccaacatggtgaaataccatctctactaaaaatacaaaaattagccaggcgtggtgccacgtgcctgtaa

SEQ ID NO: 77956 - DNA, 601 bp, Human
gaaagaaaaagtgtttataaaaagataggggaaaaaagacaaaagacgagatgagaaatgctggctagggtttggagaagagggaaccctggaacactgttggtaggaaggtagattggtgcagccattatggaaaacagtatggaggtttctatctttaaatagaaattaaaaatagaactgctggtcaggcacagtggctcatgcctgtaatcccagcgctttgggaggccgaggcgggcagatcacctgaggtcaggagttcgagaccagattggccaacatggtgaaataccatctytactaaaaatacaaaaattagccaggcgtggtgccacgtgcctgtaatcacagctacttaggaggctgagacaggagaattgcttgaacccaggaagaggaggttgcagtgagctgagactgcacaactgcactccagcctggtcaacaagagtcccccccccgctccctccccgcagaaaaacagaactaccatatgacccagtaatccctttcttgggtatataccccaaagagttgaaatcaccgcctcataaagatatctgcactctcatgttcactgcagcattattcacggtaa

SEQ ID NO: 77957 - DNA, 601 bp, Human
aaatagaaattaaaaatagaactgctggtcaggcacagtggctcatgcctgtaatcccagcgctttgggaggccgaggcgggcagatcacctgaggtcaggagttcgagaccagattggccaacatggtgaaataccatctctactaaaaatacaaaaattagccaggcgtggtgccacgtgcctgtaatcacagctacttaggaggctgagacaggagaattgcttgaacccaggaagaggaggttgcagtgagctgagactgcacaactgcactccagcctggtcaacaagagtcccccccccgctccctccccgcagaaaaacagaactaccatatgacccagtaatccctttcttgggtatataccccaaagagttgaaatcaccgcctcataaagatatctgcactctcatgttcactgcagcattattcacggtaaccaagatatagaaacaacctaaatgtccaccagcagacaagggggtaaggaaaatgaggtatatatacaataggatattattcagccttaaaaaaagagagagattctgccatttgccacaacatggatggacctggaggacattaggctaagtgaaat

SEQ ID NO: 77958 - DNA, 601 bp, Human
catctctttagataatatagttcctggtggtcatagacattaatcttggtattaatccaagctgatgtgagtgaaaaggagtaacagaaacctttctccttcctcaatagaaaattagcccaggttaactaacttttatgctatttttctagaaaatgcgataaagttgaaatgttagctgtataatcaagctacatccattatcattaaaaattactccattggggctgggtgcagtggtgtgtgcctgtagacccaactactggggaggctgaggcaagaggatcccttgacccgaggrattcaagtgcagcctgggcaacataatgagacacccatctcttaaaaaaattactccattggaaaattatacctcaattgggaggacggtgaatgaattataaatacctggtgggaagccatggctttggggctccctgcaccctacagggcaaatatactaggtttataggaagaaaatttatatgcagagaaatagtagagcacatatcatcccctgaactctcttttttttttttactgaacagagtaggcagagattatctggcattttggtcaatgtttccatagagagaggcgt

SEQ ID NO: 77959 - DNA, 601 bp, Human
tttagataatatagttcctggtggtcatagacattaatcttggtattaatccaagctgatgtgagtgaaaaggagtaacagaaacctttctccttcctcaatagaaaattagcccaggttaactaacttttatgctatttttctagaaaatgcgataaagttgaaatgttagctgtataatcaagctacatccattatcattaaaaattactccattggggctgggtgcagtggtgtgtgcctgtagacccaactactggggaggctgaggcaagaggatcccttgacccgaggaattcargtgcagcctgggcaacataatgagacacccatctcttaaaaaaattactccattggaaaattatacctcaattgggaggacggtgaatgaattataaatacctggtgggaagccatggctttggggctccctgcaccctacagggcaaatatactaggtttataggaagaaaatttatatgcagagaaatagtagagcacatatcatcccctgaactctcttttttttttttactgaacagagtaggcagagattatctggcattttggtcaatgtttccatagagagaggcgtgcctgt

SEQ ID NO: 77960 - DNA, 601 bp, Human
ctattattttattcttaacaataattacttgctaatgggatgtgtttgctttttggacattcacagcttctcagaccctggaatcagattgtgtactatctcatttcctgttccacactgattttcacatatacttgctttttgcgacaacaattgctaaaaagacctaccttgcaaatgatatggtttggatctgtgttcctactcaaatctcatgttcagttgtaatctccaatgttggagatggggcctggaaggaggtgattggatcatgggggctgtttctaattatttagcaccktcccctttgtgctgttatcatgatagagttctcacaacatctggttgtttaaaaatgtgtagcatcttccccctctccctcttcctcttgctctggccatgtaagacgagcctgcttccccttcaccttatgccatgagtgtaagtttcctgaggcctcccctgccacgcttcctgtacagcctgccgaatcatgagccaatcaaaactcctttctttataaattacccagtctcagatatttctttatagcagtgggagaacagatatatgtcatcaaacagtttgtaacatgatataa

SEQ ID NO: 77961 - DNA, 601 bp, Human
tgtagcatcttccccctctccctcttcctcttgctctggccatgtaagacgagcctgcttccccttcaccttatgccatgagtgtaagtttcctgaggcctcccctgccacgcttcctgtacagcctgccgaatcatgagccaatcaaaactcctttctttataaattacccagtctcagatatttctttatagcagtgggagaacagatatatgtcatcaaacagtttgtaacatgatataacctgtagctttaaaactgagttctacctcaagttcacacggtgtctgacagatatcaagcctggctgtgtttttcttgaaatttaaaatattctttggaggctgggcgcggtggctcacgtctgtaatcccagcactttgggaggccgaggcgggcagatcacggggtcaggtgttcgagaccagcctggccaacatggtgaaaccccgtctctactaaaaatacaaaaattagccaggcatggtggtgggtacctgtagtcccagctactcgggaggctgaggcaggagaatcacttgaacctgggaggcagaggttgcagtgagctgagattgcgccattgcactccagcctgggt

SEQ ID NO: 77962 - DNA, 601 bp, Human
atgcatctgtagttccagctgcctgtgatgggctgagatgggaggattgcttgagcccaagagttgatgttgcagtgagccacgactgcgccactgtgcactccagcctaagtgacagagggagaccctgagaccccatctcaaaaaagaaagaaacagcatgttgagtcctccgcacctcgcatctctctgatcatctcttctacttcttgttttttccacttttaagaatttatgttattagattgagctcacctggaaaatccaagataattgccccacctgaaggccagctaattarcaacattatttgcatcttcaaccattgttctcttttgccatgtaaaataacatattcacaggttctggggataggatgtagacctctttaagaagggtattattctgcataccacagtatgtcaagtttgctaatcttttttcttcagtgtctagtttgtcagtaattctatctggtgtatttttcatctcagaatttttatctctagaaattcaatttgggtctttttatattttccacgtctctacttaacacctgttagtagtaatgacatacactactgaatgtatcccccccaaa

SEQ ID NO: 77963 - DNA, 601 bp, Human
aattcaatttgggtctttttatattttccacgtctctacttaacacctgttagtagtaatgacatacactactgaatgtatcccccccaaaattcatatgttgaagccctaatcctcactgtgatggtatttggaggttgggccttcaagaagtaattaggtttagattaggttttgattaggtcatgagggctgggagtacccatgacggggctaatgtccttataagaagaggaaaggagaccatagctttgttctttctctgacataatgaggatatagtgagaaggtggctatctgmaagccaagaagaaagcctttaccagaaattgaacctgccattaccttgatcttggatttcccagctctggaattatgagaaataaaaatctgttgtttaagccatccagtcagggtattttgtgtggcagctggaggtaagacaacacctttaactattttttggacacatggaatacagttgtaatgactactttaatttacttttctgataatactaacatttgtgtcagctctgggttagtttcattagattgagttctcttgtcatgatgaattgtattttcctgcttctttgctg

SEQ ID NO: 77964 - DNA, 601 bp, Human
ttggatttcccagctctggaattatgagaaataaaaatctgttgtttaagccatccagtcagggtattttgtgtggcagctggaggtaagacaacacctttaactattttttggacacatggaatacagttgtaatgactactttaatttacttttctgataatactaacatttgtgtcagctctgggttagtttcattagattgagttctcttgtcatgatgaattgtattttcctgcttctttgctggtagtttttgattgggtgccagatgctgtgaattttaccttgttgtgtgcayggtaattttatatttctaaaaatattcttgagctttgttctggtacatagttaatttactttagaacagtttgattgttttagggcttattcttcagattttctaggcagaaccagagacactttaatccagggctcattatttctcactgctgaggctgtacccttctcaatactctacctaatgcctgtgaattataaggttttccagcctggttgatgggaatagacactattcttgaccttgtgggttctttctctggccttgggtagttttctaacacatataatctgatcagca

SEQ ID NO: 77965 - DNA, 601 bp, Human
ccagtcagggtattttgtgtggcagctggaggtaagacaacacctttaactattttttggacacatggaatacagttgtaatgactactttaatttacttttctgataatactaacatttgtgtcagctctgggttagtttcattagattgagttctcttgtcatgatgaattgtattttcctgcttctttgctggtagtttttgattgggtgccagatgctgtgaattttaccttgttgtgtgcatggtaattttatatttctaaaaatattcttgagctttgttctggtacatagttartttactttagaacagtttgattgttttagggcttattcttcagattttctaggcagaaccagagacactttaatccagggctcattatttctcactgctgaggctgtacccttctcaatactctacctaatgcctgtgaattataaggttttccagcctggttgatgggaatagacactattcttgaccttgtgggttctttctctggccttgggtagttttctaacacatataatctgatcagcactccactgaatacttgagggaaaccctttgcagatctctggagttctctgtttg

SEQ ID NO: 77966 - DNA, 601 bp, Human; identical to SEQ ID NO: 21044

SEQ ID NO: 77967 - DNA, 601 bp, Human; identical to SEQ ID NO: 21045

SEQ ID NO: 77968 - DNA, 601 bp, Human; identical to SEQ ID NO: 21046

SEQ ID NO: 77969 - DNA, 601 bp, Human; identical to SEQ ID NO: 21047

SEQ ID NO: 77970 - DNA, 601 bp, Human; identical to SEQ ID NO: 21048

SEQ ID NO: 77971 - DNA, 601 bp, Human; identical to SEQ ID NO: 21049

SEQ ID NO: 77972 - DNA, 601 bp, Human; identical to SEQ ID NO: 21050

SEQ ID NO: 77973 - DNA, 601 bp, Human; identical to SEQ ID NO: 21051

SEQ ID NO: 77974 - DNA, 601 bp, Human; identical to SEQ ID NO: 21052

SEQ ID NO: 77975 - DNA, 601 bp, Human; identical to SEQ ID NO: 21053

SEQ ID NO: 77976 - DNA, 601 bp, Human; identical to SEQ ID NO: 21054

SEQ ID NO: 77977 - DNA, 601 bp, Human; identical to SEQ ID NO: 21055

SEQ ID NO: 77978 - DNA, 601 bp, Human; identical to SEQ ID NO: 21056

SEQ ID NO: 77979 - DNA, 601 bp, Human; identical to SEQ ID NO: 21057

SEQ ID NO: 77980 - DNA, 601 bp, Human; identical to SEQ ID NO: 21058

SEQ ID NO: 77981 - DNA, 601 bp, Human; identical to SEQ ID NO: 21059

SEQ ID NO: 77982 - DNA, 601 bp, Human; identical to SEQ ID NO: 21060

SEQ ID NO: 77983 - DNA, 601 bp, Human; identical to SEQ ID NO: 21061

SEQ ID NO: 77984 - DNA, 601 bp, Human; identical to SEQ ID NO: 21062

SEQ ID NO: 77985 - DNA, 601 bp, Human; identical to SEQ ID NO: 21063

SEQ ID NO: 77986 - DNA, 601 bp, Human; identical to SEQ ID NO: 21064

SEQ ID NO: 77987 - DNA, 601 bp, Human; identical to SEQ ID NO: 21065

SEQ ID NO: 77988 - DNA, 601 bp, Human; identical to SEQ ID NO: 21066

SEQ ID NO: 77989 - DNA, 601 bp, Human; identical to SEQ ID NO: 21067

SEQ ID NO: 77990 - DNA, 601 bp, Human; identical to SEQ ID NO: 21068

SEQ ID NO: 77991 - DNA, 601 bp, Human; identical to SEQ ID NO: 21069

SEQ ID NO: 77992 - DNA, 601 bp, Human; identical to SEQ ID NO: 21070

SEQ ID NO: 77993 - DNA, 601 bp, Human; identical to SEQ ID NO: 21071

SEQ ID NO: 77994 - DNA, 601 bp, Human; identical to SEQ ID NO: 21072

SEQ ID NO: 77995 - DNA, 601 bp, Human; identical to SEQ ID NO: 35413

SEQ ID NO: 77996 - DNA, 601 bp, Human; identical to SEQ ID NO: 35414

SEQ ID NO: 77997 - DNA, 601 bp, Human; identical to SEQ ID NO: 35415

SEQ ID NO: 77998 - DNA, 601 bp, Human
tatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggygaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggc

SEQ ID NO: 77999 - DNA, 601 bp, Human
gctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaayaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtg

SEQ ID NO: 78000 - DNA, 601 bp, Human
gcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggta

SEQ ID NO: 78001 - DNA, 601 bp, Human
ctatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcayaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtg

SEQ ID NO: 78002 - DNA, 601 bp, Human
aagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctawgagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggt

SEQ ID NO: 78003 - DNA, 601 bp, Human
ccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactyagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgct

SEQ ID NO: 78004 - DNA, 601 bp, Human
ccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagmccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgt

SEQ ID NO: 78005 - DNA, 601 bp, Human
gctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatgrtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgt

SEQ ID NO: 78006 - DNA, 601 bp, Human
cttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtytcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttat

SEQ ID NO: 78007 - DNA, 601 bp, Human
atcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaarcagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaag

SEQ ID NO: 78008 - DNA, 601 bp, Human
aattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgarcagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaa

SEQ ID NO: 78009 - DNA, 601 bp, Human
aaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatrtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttat

SEQ ID NO: 78010 - DNA, 601 bp, Human
cagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggrgtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaac

SEQ ID NO: 78011 - DNA, 601 bp, Human
gatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtagrggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagaga

SEQ ID NO: 78012 - DNA, 601 bp, Human
tggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgttctggctatgggagtagktggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcc

SEQ ID NO: 78013 - DNA, 601 bp, Human
tgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagwtttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagac

SEQ ID NO: 78014 - DNA, 601 bp, Human
ctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccycttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctag

SEQ ID NO: 78015 - DNA, 601 bp, Human
attatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattcmttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatata

SEQ ID NO: 78016 - DNA, 601 bp, Human
ccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtwtttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttt

SEQ ID NO: 78017 - DNA, 601 bp, Human
accaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgyttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgtt

SEQ ID NO: 78018 - DNA, 601 bp, Human
tactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcaygcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttc

SEQ ID NO: 78019 - DNA, 601 bp, Human
tatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatycacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctt

SEQ ID NO: 78020 - DNA, 601 bp, Human
agtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcttgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaa

SEQ ID NO: 78021 - DNA, 601 bp, Human
agggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctytttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaacct

SEQ ID NO: 78022 - DNA, 601 bp, Human
acatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactrgttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttac

SEQ ID NO: 78023 - DNA, 601 bp, Human
ggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaacwgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaa

SEQ ID NO: 78024 - DNA, 601 bp, Human
ctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatrtggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaa

SEQ ID NO: 78025 - DNA, 601 bp, Human
ctcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtargaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccac

SEQ ID NO: 78026 - DNA, 601 bp, Human
taacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccctgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagt

SEQ ID NO: 78027 - DNA, 601 bp, Human
atgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacrctacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgct

SEQ ID NO: 78028 - DNA, 601 bp, Human
ttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagygatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgcc

SEQ ID NO: 78029 - DNA, 601 bp, Human
ttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaarcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaag

SEQ ID NO: 78030 - DNA, 601 bp, Human
agatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaawtttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgt

SEQ ID NO: 78031 - DNA, 601 bp, Human
taatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcycagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaa

SEQ ID NO: 78032 - DNA, 601 bp, Human
ctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaatwgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgac

SEQ ID NO: 78033 - DNA, 601 bp, Human
aaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagttyagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacag

SEQ ID NO: 78034 - DNA, 601 bp, Human
ttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttgracagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcag

SEQ ID NO: 78035 - DNA, 601 bp, Human
gtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattktagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcat

SEQ ID NO: 78036 - DNA, 601 bp, Human
cccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatrcaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttca

SEQ ID NO: 78037 - DNA, 601 bp, Human
caaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcytgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatg

SEQ ID NO: 78038 - DNA, 601 bp, Human
ggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacrgatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttc

SEQ ID NO: 78039 - DNA, 601 bp, Human
tgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctawttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttg

SEQ ID NO: 78040 - DNA, 601 bp, Human; identical to SEQ ID NO: 21427

SEQ ID NO: 78041 - DNA, 601 bp, Human; identical to SEQ ID NO: 21428

SEQ ID NO: 78042 - DNA, 601 bp, Human
agcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcat

SEQ ID NO: 78043 - DNA, 601 bp, Human
gtttgaaactaaaattactttctctgagtttggcatcagtcagatgctactgcactaagctatactttattctctccataaaatgaggtgctgtgtatgagaaaatgagtctaaaactttaaagattaaaaaaatggtagaattctcagaatccttatttgggaagagaagttacatggggaaaaactgctattgtcaatgtccttaaaatggcaaaattcatagattacataaacatggagaatgaggaaaaataaaaacaagtaaatgatggaaaatgatgtgatcatttaaaaagcasgtgatataaaattaaatttaaaaaattcgaaattgtacctaaagtatgattatatatgttgagtgcaaatgaaaaggaatgtgggaaatgatttgtaaacatatttgtaatgtgagagttgttttccatttaaaaaatatatctgttaggccacggcaggaggatctcttaagcccagaagttcaagaccagcctgggaaacacaggaacaccccatctctactaaaaataattagctggttgtgctggtgtgtgcccgtggtcccacctgctcaagaggctaaggtgggaggatctctt

SEQ ID NO: 78044 - DNA, 601 bp, Human
cactgtgcctggccttcacccaaatggaacacctgaaacttctggcttaggcactggaagctttaacgtcagctgggcattgagtggacttcaataagtgtctaaaggttcacacctgtctctttatgtttaaaatacagataaggccatctacatcctcacaaagctgttccatggtgcaaattcctggtgaatctcctagtgctataagacttttaaactaagtatgtgcatctttaaaatataataacatgttaatgaataaaacagatacttaactataatacaaggttttacttasaattaaagaaagaaatctagctcgtttgaaactaaaattactttctctgagtttggcatcagtcagatgctactgcactaagctatactttattctctccataaaatgaggtgctgtgtatgagaaaatgagtctaaaactttaaagattaaaaaaatggtagaattctcagaatccttatttgggaagagaagttacatggggaaaaactgctattgtcaatgtccttaaaatggcaaaattcatagattacataaacatggagaatgaggaaaaataaaaacaagtaaatgatggaaa

SEQ ID NO: 78045 - DNA, 601 bp, Human
agtcgaaaaaaacatacactggggaaaggacatcctattgaataaatggtgctatttaatccatcttgagttcattacctgagatctccagagatccataacagattctaataatagccattctggctggtataagatgatatctcaccattgttttaatttgcatttctagaaatcactggtgatttcaaccacaggaggcaacctgaaaaagctccaagtggtcaaagtagaaataacttggtaacaaaataaacaatgcaatactggattataacacgaagtataaataaatacatakgagcccatactgattataaaatggatagtaagtgacaataaggagttactgttgtagatagacactgataaatctatgggtgatatgacattctccagcaaaaaataaaagggaaagataaaacaggaacagcagaaagttgataactgctaagacagtatggatatacagagtctatggcattatttacttttctatgttttttaagttttcaaaataaaaagtttaaagtcataggaaaacaaataggtcatccaaattatgtgtatgttgggggaagggtggagaagcagaaattat

SEQ ID NO: 78046 - DNA, 601 bp, Human
atctctgttttctgacaatctgatcttatacctacaaatccctaaagactcctccaaaagaatcctagatttgacaaatgacttcaataaagtttcaggattaaaaaaaatcaatatacaaaagtcagtagcatttctatacgacaataatgatcaggctaaaaaccaaatcaagaacacaatccaatttatagtatctacaaaaaaattaaaatacctaggaatgtatttaaccaaggaagggaaagatctaaccaaggaaaattatgaaacaataatgaaagaagttgcagatgacataaaaaaaatggaaaaacatcccatgttcatggatcggcagaatcaatattgttaaaaagaccatactgcccaaagcaatctacaaattcaatgcaatggctatctaaatactaatgtcattttttgcagaatgaggaaaaacaattctaaaattcatatggaaccaaaaaagagcctgaatagacaaagcaatcctaagcaaataacaaagctggaggcattacattacctgacttcaaattacactacatggctatagtaaccaaaacagcatcgtactgatataaaaatagatacacag

SEQ ID NO: 78047 - DNA, 601 bp, Human
gactaccagaactttcccaggattgagagggttgatgacattgggaaaagacacttgtctttggaaatggccaaccaggagaagccaaaaattaagccagaatagttgataaaaaaggacatggcaagccctgaggacaccagctccacagaggctggaattatcgacttgaacatcaaggcccacagttttgttttgttttgttttgtttttttgaaatggagttttgctctgccactcaggctggagtatagtggcatgttctcggctcactgcaacccccgcctcctgggttcaagcrattctcccacctcctgggttcaagcgatcctcccacctcagcctcccaaaatgctgggattacaggcatgagccactgcacctggccaagatctgcagttatgaaaaacacatgctgacatattgaaaggacaaagcccacaaatgctatctgctgataagcatcaaccagaggaaaaagatgctcaaaaacctccacaaaacctattatgacaactctgggaagacatgcagggaactggggactgaagacacctttcccctctgaattaccaaacagcccactgaccgtcgcttctga

SEQ ID NO: 78048 - DNA, 601 bp, Human
aataaaaaatgacgatttaaaaatacaagtaaaaaaaatcagtgtaactatttgtgcagcacttacattgcattaggtactataagtaaccttgagatgatttaaaagttatgagaggctatgcatacattaaatgcaaataccacgccaccttatagtagggacttgagcatccgaggattctggtatctgcagcggggcctggaaccaatcccctccagataccaagggaagaatgaccatacgtgagtgagcctgtatttgcaacgttttggtctgcttaagccaaacatcaactctyactgggcggtgtcaccaatagttttacgaaatcaagctacatgtatattcaccacttattttttttctcacattcattcttttagcttaactttcttccaaaattatcctcaatctaattacaaaagcagcagctaactttattaagggttacacatcaggtattttgctaagcacttcacctgcagtatcaagtttaaccttttaagacaaggaaactgcagagacagagagaggaacaaggtcaaagagctaacaagcagagaggccgggtctgaactcaggccctgctcttagccgg

SEQ ID NO: 78049 - DNA, 601 bp, Human
acacgaagcgagcaaaaatggtgccaacagacttgcttccatgcagggttgcttgtaaaaaacttgtaaacttgtaaaaaatgcaagatctgcgaagtgaagctcaataaagcaaagcgcgcgggaaactgaggtgtgcctttatgttctgctttagcagacactaggtggcgagcgttatttgaacgtttacaggaggccctgtgtatctgcggctgcatatccatggattcgaccaaccaggaatacaaaatatttgaaaaaaataacaataaaaaatgacgatttaaaaatacaagtaaaaaaaatcagtgtaactatttgtgcagcacttacattgcattaggtactataagtaaccttgagatgatttaaaagttatgagaggctatgcatacattaaatgcaaataccacgccaccttatagtagggacttgagcatccgaggattctggtatctgcagcggggcctggaaccaatcccctccagataccaagggaagaatgaccatacgtgagtgagcctgtatttgcaacgttttggtctgcttaagccaaacatcaactcttactgggcggtgtcaccaatagttttacgaa

SEQ ID NO: 78050 - DNA, 601 bp, Human
agggaagagagaggccgggagagagatggggaaacagccagtcagtgaagcacacacaacatttattaggactaccatcttttatgggcatagtttgtgatgccccaaaataattacaatagtaacatcaaagattactgatcatagatcacagtaatagattaaaatgtaagagagagacacgaagcgagcaaaaatggtgccaacagacttgcttccatgcagggttgcttgtaaaaaacttgtaaacttgtaaaaaatgcaagatctgcgaagtgaagctcaataaagcaaagcgcgygggaaactgaggtgtgcctttatgttctgctttagcagacactaggtggcgagcgttatttgaacgtttacaggaggccctgtgtatctgcggctgcatatccatggattcgaccaaccaggaatacaaaatatttgaaaaaaataacaataaaaaatgacgatttaaaaatacaagtaaaaaaaatcagtgtaactatttgtgcagcacttacattgcattaggtactataagtaaccttgagatgatttaaaagttatgagaggctatgcatacattaaatgcaaataccacgccacc

SEQ ID NO: 78051 - DNA, 601 bp, Human
gctgctttatcaactaaatttatggaatagtctcaatcttttgtcatttcaacaatgttcacagcattttcaccaggagtagattccatctcaagaatcacttctttgctcatctgtaagactcaactccccatctgttcaagtttgatcatgagattgtagcaactgagtgacatcttcaggctccacctctaattccagttcccttgccatttctaccacacctgcagttgcttcctccccttaaagtcatccatgagcattgaaatcaactttttcaaacgcctgttgttgatatggkgacctcccatgaatcacagatgttcttaatgccatctagaatgataaatcctttccagaagacttttgattttctttgcccagatccatcaaagaaatcacttttcatggcagctatggccttatgaaatgtatttcttaaataagtcaaaagtgctcccggatccatgggctgcagaattggtgttgtgttagcaggcacaaaaacatttatctccttatacctctccatcagagctcttgagtgaccaggtgcactgtcaggaatagtattttgaagataatctttttttctgagcag

SEQ ID NO: 78052 - DNA, 601 bp, Human
agctaagcgaggtggcatgcaactgtaatcccagcttcttgggaggctgaggtggcaggattgcttgagcctaggaggcagaggctgccatgagccatgactacaccactgcactctagcccgagtgacagagtgagaacctgtctcaaaaaaaaaaagaaagaaagaaagaaaaaagaaaacaaaaaacaactggccacgcgaagtgtcagcaaggaggtggggcaacgggaacacttaatacactgctagggaaatgtgaactagaggaaaactggccgtttctttaaaaattaaacayacacttcccattataaccctggttatttacacaggagaaataaaagcatatatccacagaaagacatgtacatttaggacatgcacacagggggaagatggccatgcgaagatggaggcagagattagaattacactacctcaagcaagagaatgacaataaacgccaaggatgaccaacaatcaccattagctggaagaggcaagtaagggttctcccctcgagccctcaagaggaagaatgaccccatcaacacctttattttagatgtctggcctccagaacagtaaaagaataaat

SEQ ID NO: 78053 - DNA, 601 bp, Human
tatctctactaaaaatacaaaaattagctaagcgaggtggcatgcaactgtaatcccagcttcttgggaggctgaggtggcaggattgcttgagcctaggaggcagaggctgccatgagccatgactacaccactgcactctagcccgagtgacagagtgagaacctgtctcaaaaaaaaaaagaaagaaagaaagaaaaaagaaaacaaaaaacaactggccacgcgaagtgtcagcaaggaggtggggcaacgggaacacttaatacactgctagggaaatgtgaactagaggaaaactggccgtttctttaaaaattaaacacacacttcccattataaccctggttatttacacaggagaaataaaagcatatatccacagaaagacatgtacatttaggacatgcacacagggggaagatggccatgcgaagatggaggcagagattagaattacactacctcaagcaagagaatgacaataaacgccaaggatgaccaacaatcaccattagctggaagaggcaagtaagggttctcccctcgagccctcaagaggaagaatgaccccatcaacacctttattttagatgtctgg

SEQ ID NO: 78054 - DNA, 601 bp, Human
ataaaacaaaacctcagtaagactgctatacacccaatagaatggctaaaatttttaaaactggaagggcgcagtggctcgcagttgtaattccaacactttggaaggccaagacgggcagattgcttgggcccacgagttcgagacaagcctgggcaacatggcgaaaccctatctctactaaaaatacaaaaattagctaagcgaggtggcatgcaactgtaatcccagcttcttgggaggctgaggtggcaggattgcttgagcctaggaggcagaggctgccatgagccatgactayaccactgcactctagcccgagtgacagagtgagaacctgtctcaaaaaaaaaaagaaagaaagaaagaaaaaagaaaacaaaaaacaactggccacgcgaagtgtcagcaaggaggtggggcaacgggaacacttaatacactgctagggaaatgtgaactagaggaaaactggccgtttctttaaaaattaaacacacacttcccattataaccctggttatttacacaggagaaataaaagcatatatccacagaaagacatgtacatttaggacatgcacacagggggaagatggcc

SEQ ID NO: 78055 - DNA, 601 bp, Human
aaaaaaataaataaataaaacaaaacctcagtaagactgctatacacccaatagaatggctaaaatttttaaaactggaagggcgcagtggctcgcagttgtaattccaacactttggaaggccaagacgggcagattgcttgggcccacgagttcgagacaagcctgggcaacatggcgaaaccctatctctactaaaaatacaaaaattagctaagcgaggtggcatgcaactgtaatcccagcttcttgggaggctgaggtggcaggattgcttgagcctaggaggcagaggctgccrtgagccatgactacaccactgcactctagcccgagtgacagagtgagaacctgtctcaaaaaaaaaaagaaagaaagaaagaaaaaagaaaacaaaaaacaactggccacgcgaagtgtcagcaaggaggtggggcaacgggaacacttaatacactgctagggaaatgtgaactagaggaaaactggccgtttctttaaaaattaaacacacacttcccattataaccctggttatttacacaggagaaataaaagcatatatccacagaaagacatgtacatttaggacatgcacaca

SEQ ID NO: 78056 - DNA, 601 bp, Human
aaagagagctggctttattcttcatctggagttcccctttggcactcccctgcgtgacaccctcccttagggaggggaaagggtggtctaaaaactgcagctccagacctgctcctggcaatgcaggctcagcacagagacctgcccgggtgtgcgctggccttcccgccagctttgttattcaacagtggcctctactggtcaataaagaattgcagcaaatgagttcagaggctggagggaatggttcagggcacttgattttttccattttgttttttgcttccaaagcatatacacrcgtacacaaaataatatacagtttcatgtttactgataagaaacaagttcaaaaaaagagacgaatcttggtatcagggaaattttcagaggccattccttgccacttaaaatagtggcttaacaaatagctaccacacaaagtgaaatataacctttgacccagcaattccatttctaggaatccatcccacagataacattggtgaagataaaaaatgtatacacaggctattcatttcaggactatttgtaaaaacaaaaagaaattaaaaaggacttgagtgtctatcaacagagg

SEQ ID NO: 78057 - DNA, 601 bp, Human
atggctaaaaagggccaaggtaccgctcaggctgttgcttcagagagtacaaaccccaagccttggcagcttccacgtggtgttgggcctgtgggtgcaaagaattcaataactgacgtttgggaaccttcacctacatttcagaggatgtagggaaacgcctggatgtccagacagaaatctgctgcaggggcagggccctcatggagaacatctgctagggcattgcagaagggaaatgtggggttggagctcccagagtccccactggggcactgcctagtggagctgtgagaagagracaaccatcctccagaccccagaacggtagatccaccaagagctttgcactgtgcacctagaaaagccaaagacactcaatgcccaccatgaaagtagctgaagggggtgggtgtgggagggctgtaccctacaaagccacaggggcagagctgcccaagaccatgaaagccactccctgtatcagtgtgccctggatgtgagacacggggtcacaaaggagaccattttgagctttaagatttaatgactgcccagccggatttcggacttgcatgggggcctgtagccctttgttttg

SEQ ID NO: 78058 - DNA, 601 bp, Human
cttgagagagatgatctgaaattggaactcgtgtttaaaagaaagcagggaataaaagtttgaaaacttcgcagcatgacggtgcaataaaaaagaaaaacccattttctggagagaaattcaaataagtaacaaggagccaaatattaatcgccaagacaatggggtaaatgtctccagagcatgtcagagatcttggcagcagcccctcccatcacaagcagggaggcctaggagggaaaaatggttttgtgggccaggcccagccccgctgctactctgtgcagccttggtacttggwgccctgtgtcccagctgttccagctccagccatggctaaaaagggccaaggtaccgctcaggctgttgcttcagagagtacaaaccccaagccttggcagcttccacgtggtgttgggcctgtgggtgcaaagaattcaataactgacgtttgggaaccttcacctacatttcagaggatgtagggaaacgcctggatgtccagacagaaatctgctgcaggggcagggccctcatggagaacatctgctagggcattgcagaagggaaatgtggggttggagctcccagagtccccact

SEQ ID NO: 78059 - DNA, 601 bp, Human
cccatctctaccaaaaatagaaaaattagccgggcatggtggcatgcacctgtagtcccagctacttgggaggctgaggcaggaggatcacttgaacccaggaggcggaggttgcagtgagccgagatcgcgccactgcactccagcctgggtgacagagcaagactctgtctcaaaaaaaaaaaaaaaaaaaaagaataaacagaaagcttcatctatgagttaccaagccttccttacagagctatggaaattaaggcaacgtagcactggctcaaagttaaattgaacaatggggcasaagagaaagcccagaagcatacctgtaccaacagagaccctgactcgagggaacacagagctatggcccagaggcaaagggcagtcttttccatgaatgatgctcatctctaagacaaaaaaaaatcaaactttccccatctcacaccacatataaaaatcaaaataggtaagaagaaaaatggaggcagagttgaaaagagccactgtcagagtcaacacgaatgatgctgtggtccaaacgcttgcgtccccccaaaattcctatgttgaatcctaatgtatgtggtattgggaggtg

SEQ ID NO: 78060 - DNA, 601 bp, Human
cacatcagttcatgtatatgatctcctgcttctacagaaataaaaagagctgccccgatacaagtatacagccgcacagtccactaatgaggacagcccagactgtgggactcgccatccatctcataactgccttgggggccacattacacacaaacacagattccagaaaccttcagacaccgaaaaaacatgtgccataggcccaagcaattaggatattacaaatgatcaggaaatggcaggcgtgctgtaccatctgaatagcgtttgatgattttttaaaaacattttgtttatycaaaatactaattttcatatcaatttaacctccacagacaacacttagctgcaatctgtttctcagaccaacccatagagcattaagaattaatgtgatccaagcaactggcgaattccaaaagcatcatgaagcttaagatcacttcaagccagagcccacacttgtttcacagccctcacttttccggtccttgccctctagagcacttctcaatgcaacaaaatccaacccaagaccttgctgcaaattaaaagacctcactaatgagataacaaagactgggcttggcgcggtggc

SEQ ID NO: 78061 - DNA, 601 bp, Human
aatgcaaaaagccttgttcaaacacagaagtgctctacctaaaaatagttctaattactttttaagacaggttttcaaaatattggtttaattttacactgtttatttaaaattggtaatagttaccctaatcgatttttaacaatgaacatttttttaaaaccacactggacggctcaactgttcctttaatgagcttccaaataggcctacggaggagccaacaccccacaaataactgcagacacgacaggcgccttcaacctctacacacagacaggcctcccgccactctgggccyctgcagcaggcgtgctgccccgctggcatgagtgcaggtgcgcctgcattaacacatgaaacaagcaggttacacatcagttcatgtatatgatctcctgcttctacagaaataaaaagagctgccccgatacaagtatacagccgcacagtccactaatgaggacagcccagactgtgggactcgccatccatctcataactgccttgggggccacattacacacaaacacagattccagaaaccttcagacaccgaaaaaacatgtgccataggcccaagcaattaggatattacaaa

SEQ ID NO: 78062 - DNA, 601 bp, Human
gggtctggaacaggaccaaaacccacaaactcactaggatcttcaagcaggggaattccaaactaatgcaaaaagccttgttcaaacacagaagtgctctacctaaaaatagttctaattactttttaagacaggttttcaaaatattggtttaattttacactgtttatttaaaattggtaatagttaccctaatcgatttttaacaatgaacatttttttaaaaccacactggacggctcaactgttcctttaatgagcttccaaataggcctacggaggagccaacaccccacaaataactgcagacacgacaggcgccttcaacctctacacacagacaggcctcccgccactctgggcccctgcagcaggcgtgctgccccgctggcatgagtgcaggtgcgcctgcattaacacatgaaacaagcaggttacacatcagttcatgtatatgatctcctgcttctacagaaataaaaagagctgccccgatacaagtatacagccgcacagtccactaatgaggacagcccagactgtgggactcgccatccatctcataactgccttgggggccacattacacacaaacacagat

SEQ ID NO: 78063 - DNA, 601 bp, Human
ctgttttacagctacatggcattactctatatagatgctccataaattatgtggaacagtgatgtttccttttttattattattactgcaatgaatgtggcaataacttcttcatatagggatctttgtgacacttttgttgaagaaaatgctatggtgagattacatacaatacaaattataaacacctattttattatctcgggtttatttcagcaaggcataatactgccaagagatgccctgtgacagtcttcagtcaacaagaaacctggacataaagggaggctgctgtgccccrgacactggcccccagtgtgagaagggctcctggtagaagccgcggcagcctgggagccctcaagctggctgccatgagccagctggagaacctgggagcatccatccaccaactgggccccaaacacaccattcagtaaaggaaggtccttcttatttcaccacagcctctagaaccactggtctggggaggtgacagcagtcaggcatgaaccagacaagaaggtcaccaagccagctgatttgggaatgctggggcaggacacagaggacagcaagcgccaagggactccacgccttg

SEQ ID NO: 78064 - DNA, 601 bp, Human
ctgaacttcagcctgggtgacagagctagaccatgtctccataagaaagggaggggaggggaggggagggaagaaaggaggggagaaaggaagagagagaggagggaggagaggagaggaaggaaggacggacagacggttccagacctattattctagaatccgccttttccatttatattgtgtacatctttccatgccaggatgaaaattccacctgaactgttttacagctacatggcattactctatatagatgctccataaattatgtggaacagtgatgtttccttttttattattattactgcaatgaatgtggcaataacttcttcatatagggatctttgtgacacttttgttgaagaaaatgctatggtgagattacatacaatacaaattataaacacctattttattatctcgggtttatttcagcaaggcataatactgccaagagatgccctgtgacagtcttcagtcaacaagaaacctggacataaagggaggctgctgtgccccggacactggcccccagtgtgagaagggctcctggtagaagccgcggcagcctgggagccctcaagctggctgccatgag

SEQ ID NO: 78065 - DNA, 601 bp, Human
aggaaaagtcagaaaaggcaaatctatagtcagaggaaagagcagggattgcctgggggttggaatgggaactgtctgcacatagacataagaatctttttggaaatgttctaaaactggactgtggtgatgactacaaaactctagaaatttactaaaaccactaacttttatacttaatgcaagtaaaacttacagtatgtaaattatctcaataaagctgtttaggctgggtgccttggatcctgcctgtaatcccagcactttgggaggctgaggcagaaggattgcttgaggccargagttcgagaccagcctgggaaacagagcaagaccccatctctacaaagcattttaaaaactagctgggcgtggtggtgtgcacctgtggtcccagctacttgtggggctgaggtgggaggattgtttgagcctgggagtttgaggctgcagtgagctgtgaccaggccactgaacttcagcctgggtgacagagctagaccatgtctccataagaaagggaggggaggggaggggagggaagaaaggaggggagaaaggaagagagagaggagggaggagaggagaggaaggaaggacg

SEQ ID NO: 78066 - DNA, 601 bp, Human
ctctatatctggtctagagaaatgaactccatgtccacacagacagtgtgacaagacaagtgtttacagcagcattgctcaaaagagccaaaaagtaggaagcccaaatgtccatcaactggggaatggaaaaggaaggagctgctgatacatggtataacatggatgaactgcaaatacattctgccaagtacaagaagccaggcacagatgattagacagtgtatgattccacacataggaaaagtcagaaaaggcaaatctatagtcagaggaaagagcagggattgcctgggggttrgaatgggaactgtctgcacatagacataagaatctttttggaaatgttctaaaactggactgtggtgatgactacaaaactctagaaatttactaaaaccactaacttttatacttaatgcaagtaaaacttacagtatgtaaattatctcaataaagctgtttaggctgggtgccttggatcctgcctgtaatcccagcactttgggaggctgaggcagaaggattgcttgaggccaggagttcgagaccagcctgggaaacagagcaagaccccatctctacaaagcattttaaaaac

SEQ ID NO: 78067 - DNA, 601 bp, Human
ggggaaaagttctgaagttcaccaaagaagatacatgaacggccaataagcccattaagagatgctcaacatcattagtcgtcaaggaaatccaagtcaaatctgtaaggagaccccactttacacccacaagaacagctgttatcagacaacagcagtgttggtgtggaagtggagaaactggaatgctcatacactgctgctgggaatgcaaaatggtgagctactctaggaagatagtctgatagtttcttaaaacattaaacgcaaatttactccacaccccagcaattccacaccyctatatctggtctagagaaatgaactccatgtccacacagacagtgtgacaagacaagtgtttacagcagcattgctcaaaagagccaaaaagtaggaagcccaaatgtccatcaactggggaatggaaaaggaaggagctgctgatacatggtataacatggatgaactgcaaatacattctgccaagtacaagaagccaggcacagatgattagacagtgtatgattccacacataggaaaagtcagaaaaggcaaatctatagtcagaggaaagagcagggattgcctgggggttgg

SEQ ID NO: 78068 - DNA, 601 bp, Human
gttccatcaacaagaaaacaaccgaatataaaaatggggaaaagttctgaagttcaccaaagaagatacatgaacggccaataagcccattaagagatgctcaacatcattagtcgtcaaggaaatccaagtcaaatctgtaaggagaccccactttacacccacaagaacagctgttatcagacaacagcagtgttggtgtggaagtggagaaactggaatgctcatacactgctgctgggaatgcaaaatggtgagctactctaggaagatagtctgatagtttcttaaaacattaaaygcaaatttactccacaccccagcaattccacacctctatatctggtctagagaaatgaactccatgtccacacagacagtgtgacaagacaagtgtttacagcagcattgctcaaaagagccaaaaagtaggaagcccaaatgtccatcaactggggaatggaaaaggaaggagctgctgatacatggtataacatggatgaactgcaaatacattctgccaagtacaagaagccaggcacagatgattagacagtgtatgattccacacataggaaaagtcagaaaaggcaaatctata

SEQ ID NO: 78069 - DNA, 601 bp, Human
tggaaaatattcaaatacagaagtatataaaataaaaagcaaatacctccctcactccccctcccaaaatcacctccttgaggtaaccagagttaagtttggttattgttccagcttttctctatgtgtgtataaattcacatactctaatctacaaaactggatttctaaaaattcaaatgtatcatggcattgctgagaattttaaaacacctaaataaatggagagacagtccatgttcatggattagagcactcagtactgatatgatggcaatatccctcaaacttatctaaagaytcaatgtagtctcaatcaaaatcccaccaggcattttgtagaaattgacaagctgaccctaaaatgtaatggaaatgcaatggcctagtaaacaatcttgaaaaagaacaaagttggcggacttaaatttcccaattttaaaacttaccatgaagctccagtaatcaagacagtgtagtaatggcctaaggataggcatagatcaatggaatgcaattcagagtccaaaaataaatccttgcatttatagtcaactgatttttgacaaaggtgccaaaattatgcaatggggaaagaact

SEQ ID NO: 78070 - DNA, 601 bp, Human
ctgctgttctctttatcaagtttgtcacagcacatagacaagaagtctccaacgcacatgtgataaagaattaaaatcacagagaatgcaaactcatccatcagtatttaaaacctgaagtggatgactaagggacgatggccctccaaaagctggagccagctgagctggagacgggaagggcaaactgcttcatgggcaccctccactctgggggaaggataagcacctcccttacgctacagaatcgacagagggcacccagcaggaagggcatgagggctcccggcatctgagcttgggtgcgtctccttccttcagtccctgctctgcagttcagcaaaagcttcttgccgatgttcccaccccactaatgcccaggacagcaggaccaaggtgggctgcacacacagcccccacactgggcactttaaaagccctaggacactggctctgctatgccaggttgtgcttgtggctgtgccaggcagtgaggagttaaatagaaactgatcccaataccctcgtagcaagaggacgaggctgtaagaagccgtgatttggggaagtgccttcctgcactttcctccagcacttggtc

SEQ ID NO: 78071 - DNA, 601 bp, Human
agatggcctcacctgggaatcttcaaaagaaacaacaacaaggaggacacaaatatatccaaagcaaatgtaaatttttcaaagcctgcaaattatgctgccttattgattgaaatcatgacctaaactctttcggagctgagctaaggacaagcattagattaagcatcataatgaccctgcactctacacaggaggcacgcttgcaacagctcagactgttttgctgtcttgtgggtgaattagatacaaaagcaaatattgaaaacacccatggcctactcctgactagcaattctcyctcctcacaaaggacaactgccttgtcactgtcctcctccagagttgtgaccattcctcagcaacagtgtgggtcacttatatgccagtgaaaagcgaagatcagcctcttctgtctttccacactcaactcaagggagagattgttcttctttgcattgcctttctaacactttttactttctagataagagaagcagcaggcaggtcagagtgccttatggagcacccagggcaagtgggtgccctgagcttcgccggcaagcggtgttccaggaactggtgcgctcgccacttcagc

SEQ ID NO: 78072 - DNA, 601 bp, Human
tctttgtttctcataatagggctttctttaaaaaaaattttttttaatccaccaggtcgttcctagcctcagaagcatgaccaaacatttcctgaagtgcgcccacatcttaaatatcaaagttatttgcaaatgctccggtttactactggtttgaaactgggatttctttctcttttctagaacgcctggcgcccagacaggagggcagatgggcagtggtgtgcagcagcatgcctgaccccatggaacatgccttccaggcaactcccgagccaggagtgggagacgccacagtgcygtttttggacaagttttattgccatactcccagacaacctcacttctctttcaccgaagatggcctcacctgggaatcttcaaaagaaacaacaacaaggaggacacaaatatatccaaagcaaatgtaaatttttcaaagcctgcaaattatgctgccttattgattgaaatcatgacctaaactctttcggagctgagctaaggacaagcattagattaagcatcataatgaccctgcactctacacaggaggcacgcttgcaacagctcagactgttttgctgtcttgtgggtgaat

SEQ ID NO: 78073 - DNA, 601 bp, Human
caggactgctgaatgacagcggcagacaacgaaacagtggaagttgcactgggtgtgactcatcagatcaataaataggtcagtaaacccgttctccgtctacgaactgaaagaacaagtcccttcctaaacagctctgctcctctaacaacaaaggctaaggcagaaagaacagtcgtgcaggggccgaggcctggatgagcagaggacagtccacaccagacctactgccttcagaaagaatccaggatatggcacaggaaaaaaataatttaaaaaaatatacgttttaaatcttcarttaaaaaatagatttcttaaaagtaaaaatttgttttaaaaatcttaaaattatcttggttcagtgaaattaataacaacagacttggaaatatttatctctataattaaaggaaaaagacaaaaatcaaaaagaaactgaacgaagagctttagctttcacctggaggcggcactcagggctgtcggcagcaacagcagatgccagcacggctcatggccctagcagggctgatctgcgggcaacagtcagaagagaacaaagcagtgattgcttcatggagacaagatttttcaatct

SEQ ID NO: 78074 - DNA, 601 bp, Human; identical to SEQ ID NO: 27204

SEQ ID NO: 78075 - DNA, 601 bp, Human; identical to SEQ ID NO: 27205

SEQ ID NO: 78076 - DNA, 601 bp, Human; identical to SEQ ID NO: 27206

SEQ ID NO: 78077 - DNA, 601 bp, Human; identical to SEQ ID NO: 27207

SEQ ID NO: 78078 - DNA, 601 bp, Human; identical to SEQ ID NO: 27208

SEQ ID NO: 78079 - DNA, 601 bp, Human; identical to SEQ ID NO: 27209

SEQ ID NO: 78080 - DNA, 601 bp, Human; identical to SEQ ID NO: 27210

SEQ ID NO: 78081 - DNA, 601 bp, Human; identical to SEQ ID NO: 27211

SEQ ID NO: 78082 - DNA, 601 bp, Human; identical to SEQ ID NO: 27212

SEQ ID NO: 78083 - DNA, 601 bp, Human; identical to SEQ ID NO: 27213

SEQ ID NO: 78084 - DNA, 601 bp, Human; identical to SEQ ID NO: 27214

SEQ ID NO: 78085 - DNA, 601 bp, Human; identical to SEQ ID NO: 27215

SEQ ID NO: 78086 - DNA, 601 bp, Human; identical to SEQ ID NO: 27216

SEQ ID NO: 78087 - DNA, 601 bp, Human; identical to SEQ ID NO: 27217

SEQ ID NO: 78088 - DNA, 601 bp, Human; identical to SEQ ID NO: 27218

SEQ ID NO: 78089 - DNA, 601 bp, Human; identical to SEQ ID NO: 38970

SEQ ID NO: 78090 - DNA, 601 bp, Human; identical to SEQ ID NO: 38971

SEQ ID NO: 78091 - DNA, 601 bp, Human; identical to SEQ ID NO: 38972

SEQ ID NO: 78092 - DNA, 601 bp, Human; identical to SEQ ID NO: 38973

SEQ ID NO: 78093 - DNA, 601 bp, Human; identical to SEQ ID NO: 38974

SEQ ID NO: 78094 - DNA, 601 bp, Human; identical to SEQ ID NO: 38975

SEQ ID NO: 78095 - DNA, 601 bp, Human; identical to SEQ ID NO: 38976

SEQ ID NO: 78096 - DNA, 601 bp, Human
ggctttcagcccactcaccttgctctggtacaaggactcggcctcagctttgctcttctgggctatatcctcgtactgggccttgacctcagcaatgatgctgtccaggtcgagactgcggttgttgtccatagagaggatgacattagtttcactgatttgagtctgcatctgagacaactcctgcaagacataataggttagtgactcttacagcactaaaacaaaaaacaacttagacagagaaagcagtcaggaaataaaagataaatatctattcttctgaatcgttgtgggttcmggcttaaaaactctccatttagataaacttggttgaaactggaagacttactgcttggtagagtgctgtaaggaaatcaatttcctgctgcaagttgtcaagtttggcctgaaggtccaccttggtcatataagcaccatccacatcctagaggaacaagggacatcatgaaggcacattctctccagggcaggtccctctcattacctgtgaggggattctccaagcaaaaaaaggagctttgggtctactccactcctttttgccccaggtaaatcacagttccctaactgtcccacc

SEQ ID NO: 78097 - DNA, 601 bp, Human
cttggccttaagtcatctcacacccacctccagataacacatcaccatgttgacttccttaaaagaccttagggataactcaacagcctctcttggccctgagtcaaggctcctacaacccttacagacttgacattcttctaaacacctactctaaaacctcctggctgcccttcctctcactccccaactcttaagtccactttgggtcataggctagatcactcacattgaccatcccatctttctctactaggccattctcacagatttccctaaagagaacccagcatgatggctrcattctggaaactagcatagtcacaaaaggaaccagggataataatgtagccttgggatgaattgcaagattcaaaactaggaaagcactcgccctttacctgagggttacccccattccatacagctgagtggtagaaggagaaagcacatacctgcttcttgacattgtcgatttcagatctaagtctctggatcacacgattcagctcagaaatttctatctttgaatttctcacactatccccatgtctgccagcagtgatctgcagctcttcatactaaagatggtagatagcgt

SEQ ID NO: 78098 - DNA, 601 bp, Human
cagcttgttcttggcatccttgagggcattctcgccacgctgctctgcatcactgatggactgctgcaagttggagatctgaaaaagaatatgacaccctctcataatatgcattccccactaggcctcctcatcccaattggtctccccactccagtgaggccaataatgagtccaacagaaccacttggccttaagtcatctcacacccacctccagataacacatcaccatgttgacttccttaaaagaccttagggataactcaacagcctctcttggccctgagtcaaggctcctwcaacccttacagacttgacattcttctaaacacctactctaaaacctcctggctgcccttcctctcactccccaactcttaagtccactttgggtcataggctagatcactcacattgaccatcccatctttctctactaggccattctcacagatttccctaaagagaacccagcatgatggctgcattctggaaactagcatagtcacaaaaggaaccagggataataatgtagccttgggatgaattgcaagattcaaaactaggaaagcactcgccctttacctgagggttacccc

SEQ ID NO: 78099 - DNA, 601 bp, Human
tgcgaacatgattcagaaccacattgcaagaagtgcagaagagttttcctccatcttcatgcagctcacctccaaactcagtgactcgatccaggggagtcacatacaaagcagtcttagaacggtttcgagcaggtggtgctgttactacaaatcgctccattctgactctaaataaatatggttctttcaagacaaaagaaacaaagatgagtattataacaacagttcattctggaagtaatgaacaataaaaggcagtatataaacacttcaaatacttcaaaaaacttaattcaamttagtagactgtgtgtctattaatcttaacttacctgaaatatataagggaaggcaaaactagaacaagttactaaccagtcgcaatcaggtccattccttgatttttacgaaattcaagtaaattagactataaagaaagaactcaaactatcccagatgtcaccattatttagggaaacctaatcacagttcaacatttaggatataaattacattcaggatataaattgtattaatctcatctaacttagatatgcattcaagttcaaaagagcttctttcctgtcacaattctggg

SEQ ID NO: 78100 - DNA, 601 bp, Human
cctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggrctccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccggg

SEQ ID NO: 78101 - DNA, 601 bp, Human
aattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttcccyagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatctt

SEQ ID NO: 78102 - DNA, 601 bp, Human
gaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaacwttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaatag

SEQ ID NO: 78103 - DNA, 601 bp, Human
aagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatkaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcaga

SEQ ID NO: 78104 - DNA, 601 bp, Human
atcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaaaagtaaggaagagactgataagcccgatattcaggacgccagttacctctggtgcaggcagayatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttt

SEQ ID NO: 78105 - DNA, 601 bp, Human
ggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgayattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggt

SEQ ID NO: 78106 - DNA, 601 bp, Human
agcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgyaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacat

SEQ ID NO: 78107 - DNA, 601 bp, Human
atcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacytggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggactggaggtgggagaggcctctgagagcaagcagtgctgtccaccagaagctcttgctggggtgcccagagaggagcaaagggcagtcagctgcacaggagggaatgtttggaggagagagc

SEQ ID NO: 78108 - DNA, 601 bp, Human
accttgctggcttctgggaagaagctcagtgagacgatgtgttagcagagtgtctgacaattgtaagaattcaacaagtaatagttattattaccatcactggtgagaggaagtgatacctggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggacyggaggtgggagaggcctctgagagcaagcagtgctgtccaccagaagctcttgctggggtgcccagagaggagcaaagggcagtcagctgcacaggagggaatgtttggaggagagagccacctcagatcagcgggtcaagaatcccactcttgcccagatggatggggcaaaggagaaaaaggattcgccacgggaatgtccagataagacaggtgccttttggaaaatgggggtgagatgggtctcaggttacacttcgtaagaactggaatgtaaagtaaaggcagacaatgacaaa

SEQ ID NO: 78109 - DNA, 601 bp, Human
actgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaawttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaat

SEQ ID NO: 78110 - DNA, 601 bp, Human
cacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaaytgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaaga

SEQ ID NO: 78111 - DNA, 601 bp, Human
ttctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaastctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaatt

SEQ ID NO: 78112 - DNA, 601 bp, Human
aaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagmtggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggata

SEQ ID NO: 78113 - DNA, 601 bp, Human
aaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccacctyccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttca

SEQ ID NO: 78114 - DNA, 601 bp, Human
ctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgyctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgac

SEQ ID NO: 78115 - DNA, 601 bp, Human
aggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccarctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatca

SEQ ID NO: 78116 - DNA, 601 bp, Human
ttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagaygggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggg

SEQ ID NO: 78117 - DNA, 601 bp, Human
tgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtggggrctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtga

SEQ ID NO: 78118 - DNA, 601 bp, Human
acttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgrgtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatcctt

SEQ ID NO: 78119 - DNA, 601 bp, Human
aggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatrgatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggcc

SEQ ID NO: 78120 - DNA, 601 bp, Human
cttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatcccctyctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgtt

SEQ ID NO: 78121 - DNA, 601 bp, Human
aattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccasatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggt

SEQ ID NO: 78122 - DNA, 601 bp, Human
aattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcmacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaag

SEQ ID NO: 78123 - DNA, 601 bp, Human
tttgtttaattttagttgagtctatcaactcaaaaaagaataacctacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtag

SEQ ID NO: 78124 - DNA, 601 bp, Human
ttactgttttccagtgtagaacttttatcaaggtcagcttgttttgctgctgctgctgctttttttaaatacagggtcttgctctgttgcccaggctagggtgcagtggcgcgatcatggctcactgcagccccgacttccctggcttacgtgatcctcccacctcagcctcccgagtagctaggaatacagacacacaccaccacacctggcaattttttttttttttttttggtagagatgggggtctcactatattgcctaggctggtctcaaactcctgggctccagtgatcctccsgccttggcctcccttgtttttgcttcttaatcagcattttaaaaatatatacatattaagatctttgagtcaagcactgtgttagggaaatcagtttacttgctcagcatctcgtaattagtaaatgaaggagagggtcagctcagggtttgttgagttttaaaatgtgctcctacgtcctctggatagtgtttatacagccaaattttccctcgttttttattcctatctcttggtaaatctctgtctttattattttcagctttttagctgcctttcatgtgctatatgaagtcttcc

SEQ ID NO: 78125 - DNA, 601 bp, Human
actgtgttagggaaatcagtttacttgctcagcatctcgtaattagtaaatgaaggagagggtcagctcagggtttgttgagttttaaaatgtgctcctacgtcctctggatagtgtttatacagccaaattttccctcgttttttattcctatctcttggtaaatctctgtctttattattttcagctttttagctgcctttcatgtgctatatgaagtcttcccaaaatctaaaattaaaaagaaatggtaaatggtgatagaagctgtctctgtgaccagtttttttattagtatgcygtacatagaggggcagcatcacagacatgatctgtgtataaacagtgaattttgcagtattttgctatagacagcatttccaacttaatttagactactgatctaatcaggaactggatgagataatttagtgcctgcgtaagaatcttcactctgctttttattagctgttgtaaccacgggcaactcacttaacaactaccttatggactgagttttgactttatctataaaatgggaataaaacaacacagttttatttaaactgtctaaccctgcacgtggtcaggagtagatact

SEQ ID NO: 78126 - DNA, 601 bp, Human
caaaaaaaaaaaaaaaaaaccctcataagtaaggcacaattgattgtgtgctgtttccctgaaaatattggaaaatgctctacttttgatagtatatggcatgtgcattttagtgttctaatgtgatcatttatctgcttataaaagtgcttttgatagcaagtgtgttaaagtggtcttaaagtgtttagtatgttaaagttctgctattgtaagctagtgagctttggttaacaccataagtgataactatgtaagacattaataatttttttgcaattttatattttaggttacattrtaagtgtgatttttttttttttttttgggagacagagtcttgctctgtcacccagcctggagtgcagtggtggggtctcggtgcgatcgggttcaagtgattctcctgcctcaacttcccaagtagctggaacttacaggcatgtgccaccacggctggctaatttttttttatttagtagagacggggtttcaccatgttggtcaggctggtcttgaactcctgacctcaggtgatccacccgccttggcctcccaaagtgctggaattacaggcgtgagccactgcgctcggctcagt

SEQ ID NO: 78127 - DNA, 601 bp, Human
gtagaaattcttacgaaattggagtcagtcctctcaaaccctgccaccaccttatcagctaggcttatgtaatatttgaatcctttgttgtcatttcaacaatgttcataccgtcttattaggagtagattctgtctcaagaaaccactttctcatccataagaagcaactccttatccattcaagttatatcatgagattgcagcaattcagtcccatcttcaggatccacttctgagttctcttgatgtttccaccacacctccagtcacttcctcccctgaagtcttgaccccctaastcatccatgagggttggaagtgttaactgaattgagtgactgaggcagctgtctcaatcaaggtttattgagctagcttaaggatgctcccaggaaaaacgcaaggcacagatgcatctgtggctgttttgtccaaagaggttcttaggagggttagtgtttatacattttccttaaaacatgaggggtggtggcagtgaggcaaatggttacctacttgtgagactaattaatgcccagtaaatctacattttatataagataaacctttgaagcaaaaggaaatagaagaagaaaaca

SEQ ID NO: 78128 - DNA, 601 bp, Human
taccacgggggtctggctaatatataatgtttcgacacaaacttgtaagagttattcgtccaggaagaggatggccatttagcatgactcagcctccaaggttaaattcctgttttggcataggagttttgggaatcctgagattttatttccctttatagaatcagcatcttctaatcacctgttcataatgatatttagaccttctcccatgaatcataaatgttctttttttaaaaattttattactaatttttgggaccgagtctcgctgtttccccggctggagtgcagtggcacratcttggctcactgcagcatccgcctcccagattcaagtgattctccttcctcagcctcctgagtagctgggattactggcacgcgccaccacacctggctaatttttgtatttttttttagtagagatggggtttcaccatgttggccaggatggtctcgaactcctgacctcgagtgatccacctgcctcagcctcccaaagtgctgggattacaggcgtgagccactgcgtccagcccatgtctttattaagaagcaaatatgtggttaataaatttgattgtaaaatactacagtg

SEQ ID NO: 78129 - DNA, 601 bp, Human
tttattactaatttttgggaccgagtctcgctgtttccccggctggagtgcagtggcacaatcttggctcactgcagcatccgcctcccagattcaagtgattctccttcctcagcctcctgagtagctgggattactggcacgcgccaccacacctggctaatttttgtatttttttttagtagagatggggtttcaccatgttggccaggatggtctcgaactcctgacctcgagtgatccacctgcctcagcctcccaaagtgctgggattacaggcgtgagccactgcgtccagcccatgtctttattaagaagcaaatatgtggttaataaatttgattgtaaaatactacagtgacttataaaataagaatggtgtccatattaaaatgaaaaatggcactgtttatattttaaattgtgactttattttctttttttcttttttttttttttcagacggagtcttgctccgtcgcccaggctggagtgcagtggcacgatctcggctcactgcaacctccgcctcctgggttcaagtgattctcctgcctcagcctcctgagtagctgggattacaggcaaccaccaccatgcc

SEQ ID NO: 78130 - DNA, 601 bp, Human
tgggaccgagtctcgctgtttccccggctggagtgcagtggcacaatcttggctcactgcagcatccgcctcccagattcaagtgattctccttcctcagcctcctgagtagctgggattactggcacgcgccaccacacctggctaatttttgtatttttttttagtagagatggggtttcaccatgttggccaggatggtctcgaactcctgacctcgagtgatccacctgcctcagcctcccaaagtgctgggattacaggcgtgagccactgcgtccagcccatgtctttattaagmagcaaatatgtggttaataaatttgattgtaaaatactacagtgacttataaaataagaatggtgtccatattaaaatgaaaaatggcactgtttatattttaaattgtgactttattttctttttttcttttttttttttttcagacggagtcttgctccgtcgcccaggctggagtgcagtggcacgatctcggctcactgcaacctccgcctcctgggttcaagtgattctcctgcctcagcctcctgagtagctgggattacaggcaaccaccaccatgcctggctaatttttgta

SEQ ID NO: 78131 - DNA, 601 bp, Human
cgttaaatagttacttgcttagggctgggaagtgaaggctaactcctctggggttcagggcacacctgaaaggtgtgtctgtgctgagactcggatgaaaggggactgactaccctcagaatatctgggatggggcacttaggtggagaggccatcccctctttaccttttacttttgtctctcaatcttattcctctttccttagctggaaggcatggttggaaactcagcatgaaattttgagagttacagtgaggatagagaggaaggaataaatggcattttaaaggggaaaaaaaagagtatgatcttgtaacttatggtcagaggacactaaaatatcaaatggtacatcaaggttgtaagccatggagtctagagccttgactagtgaatatggagatggagcttgtgtaaatggttgtgggtataccactttggagtcaattttctaggagttattattattatttccttaagagacagtctcgctgttacccaggctgctctcaaactgctggcctcaagtgatcctcccgcctcagcctcccaaagcactgggattacaggcgtgagccccgacgcctggccaggaattat

SEQ ID NO: 78132 - DNA, 601 bp, Human
cattctctgtttaatttttggaaagtggactttatcttgactttcccaagaagagtctgggaagtagcaaacgagattatagaaattctgaaacttggataagagctgttgggctagaagggtattgtaagggcttgcagagaaaggtgggctgataattttaatttttattatatttctaatctctacataattcatttcttttggatttgttagtaggctattccatggcttatatgtaatcttaaaaatattcttctaaagttgcaagtcatttgctttcctactgactttaacttartatccattgatattacatttattttccaggtatctcaacacccagtttattaaaaagaataaattaacagaagcggaccttcagtatggctatggtggtgtagatatgaatgaaccacttatggaaataggagaggtaggacattctttaagtgactagcaaacataagtatgtttttatacactgaggtaatttgattgcacatcattttttaaggacactgatttggctagcttaaaatggtcaagatttaaaagatcctaaataaaatgctatagtgatttcctaagaatcctcagg

SEQ ID NO: 78133 - DNA, 601 bp, Human
taatatccattgatattacatttattttccaggtatctcaacacccagtttattaaaaagaataaattaacagaagcggaccttcagtatggctatggtggtgtagatatgaatgaaccacttatggaaataggagaggtaggacattctttaagtgactagcaaacataagtatgtttttatacactgaggtaatttgattgcacatcattttttaaggacactgatttggctagcttaaaatggtcaagatttaaaagatcctaaataaaatgctatagtgatttcctaagaatcctcgggaacgaaaaagatgtgacaactactcttttgataattaaatttataatggatgaatgatagagttaatggttctgcattgtgaaaaaactcagaaacaattataaagtgttgacggccctgtagttaaaaagtgcaggggacaagtacttaaaagacaggctagaggagaggaaacacaaatttatggatacaacaaatttattgtaactttactttaaaagtaattaaattcagagtgaaacaattaaatgggcagtttggtccattcaagttcttgaggtacagtgcaaattaaaat

SEQ ID NO: 78134 - DNA, 601 bp, Human
aaatggtcaagatttaaaagatcctaaataaaatgctatagtgatttcctaagaatcctcaggaacgaaaaagatgtgacaactactcttttgataattaaatttataatggatgaatgatagagttaatggttctgcattgtgaaaaaactcagaaacaattataaagtgttgacggccctgtagttaaaaagtgcaggggacaagtacttaaaagacaggctagaggagaggaaacacaaatttatggatacaacaaatttattgtaactttactttaaaagtaattaaattcagagtraaacaattaaatgggcagtttggtccattcaagttcttgaggtacagtgcaaattaaaatatggaaaattatgctgattgtgaaagaagtattattgtacaagcttgtttattcatttaatacatctttattgagtagccaggcattggggatacaatggtgaacagacagaaggtccctgcacacaaaagcttgtaagttcatgtaagggaagcagatgccaaataggaaattaatgttaacttgtgatttatgttaatgaaggaaataaacaggctaagaggcagcattaggagacat

SEQ ID NO: 78135 - DNA, 601 bp, Human
atttcttgcctttttttttgttatttgttactgtctgtctttttacataagtttgttttttgtgaaagcttaatattctgtagagatacagaataattttttaaactatccctttaatttttttttttcttttttttttttgagacggagtctcgctgtgtcacccaggctggagtgcagtggtgtgatcttggctcactgcaagctctgcctcccaggttcacactagtctcctgcctcagcctcccaagtagctgggactacaggcgcctgccaccacacccggctaattttttgtatrtttagtagaggcggggtttcaccgtgttagccaggatggtctcgatctcctgaccttgtgatccgcctgcctccgcttctcaaagtgctgggattacaggtatgagccaccgcgccccccaatttttaattttttgttattacaaacaacactgcagtgaacaccactattcatttattcattcattaagtatttttgaacccgtctgtgttatatatgttgaatacaacagtgaacaaaatagagaaaaatcttatgctcatggagttatatttatgtgtatctcttggtacatgagca

SEQ ID NO: 78136 - DNA, 601 bp, Human
tccgcctgcctccgcttctcaaagtgctgggattacaggtatgagccaccgcgccccccaatttttaattttttgttattacaaacaacactgcagtgaacaccactattcatttattcattcattaagtatttttgaacccgtctgtgttatatatgttgaatacaacagtgaacaaaatagagaaaaatcttatgctcatggagttatatttatgtgtatctcttggtacatgagcagaactttttatagactgggtgtcaggaagtggagcctctgtcgaagcacatcctgaagtttygcagctctgccccattgcctttcagaagggcctttaccagtttgcccttccaccacatgtgtaaaataccagtttttcatgtattgcctccccaacccccattcatgctattaagaaagaaaggcaaaacttgaacagtgttccttgtgggaagacagatgcttaattaccaatggatcagaataaaattaccctagggaaacaatagggaggctagcaacagcctatctggatgtagttagggtggaaaaagagaagagtcaaacaaacaaaaaattggttttcagtactggaataatt

SEQ ID NO: 78137 - DNA, 601 bp, Human
tttttttcttttttgagacggagtctcgctctgtcacctgggcgggagtgcagtggcgcgatctcggctcactgcaagctccgcctcccgggttcacaccgttctcctgcctcagcctcccgcatagctgggactataggcacccgccaccacgccccgctaattttttgtatttttagtagagatggggtttcaccctgttagccaggatggtttcaatctcctgacctcgtgatccgcccgtctcagcctcccaaagtgctgggattacaggcgtgagccactgtgcctggccaaggaracactattttatgtccagcagactggcaaaatttgactaaagcctggcagtaccacttgttgtcaaggatggggactaatgggaaatcttgtgctttgctatgcaagtataaattggaaaatcatttggcttgatttagtaaagctgcatgagcacttgattgttcagtacaggatctcaacttgtagatgtatatcagagaatctgttgcttatgtgggccaaatgatgcatacaggaatcacagcattgtttccagtagcagaaaataggaatcacagacacatcagcagtcatcagc

SEQ ID NO: 78138 - DNA, 601 bp, Human
tttgagacaggattcccactctgtctactaggctggagtgcggtgacatgatttcagctcactgcagcctccgcctcctgggttcaagcaattctcctgcctcagcctcccgagtagctgggcaccaccacgccctgctaatttttgtatttttagtagagaccggttttcaccatgttggccaggttggtctcgagctcctacctcaagagatccaactttctcggcctccaaaagtgtggggattacaggagtgagccaccgcacccggcctttatgcctgtattttttttttttttttgagacagtcttgctctgttgcccaggttggagtgcaattgcacgatcttagctcattgcaacttctgcctgctgggttcaagcgattcttctgcctcagcctcccgagtagctgggactacagacgcgcaccaccacacccggctatttttttttttttttagtggagacggggtttcaccgttttagccaggatggtctctatctcctgacctcgtgatccacccgcctcggccttccaaagtgctgggattacaggcgtgagccactgcgcctggcccagaaatctttaaccaaatta

SEQ ID NO: 78139 - DNA, 601 bp, Human
cacatatgtagatgtttgcttggggtcatagggtgtgtatacttagagttttgccagtatgtcctccacagtatctgttcttccaccataagcagaacatgagaaaataggtaacagttcagatcagtatctcaccagattgaatgtgggcttatgtgaggtcacgcatgtgacccaagccaaggaaatgagctcacatgtgtgaccttattatatgaactagtcagtgatatcaagatatcaagattctctatgactgacagaattactgtagccatattaattcatgtccaaaaaatakttctcagaatatccaaataattaaaggaagaatcaaagaggactagaggggttcagaggcagggaaggactctagtatgtaaaggtaattgcctggatgcttttccttgatgcttttcttcaatgatagaaaattcttacatcctatatatagagcaacaagctcttactagggaatgatgataataagttttctgttgctctctttgtgacattattaatgcaaagaagaaattattttaaagtaggttggaagagtgtgtagtgaggtaaaccataatggtttgatttgagcattggt

SEQ ID NO: 78140 - DNA, 601 bp, Human
tgtcctccacagtatctgttcttccaccataagcagaacatgagaaaataggtaacagttcagatcagtatctcaccagattgaatgtgggcttatgtgaggtcacgcatgtgacccaagccaaggaaatgagctcacatgtgtgaccttattatatgaactagtcagtgatatcaagatatcaagattctctatgactgacagaattactgtagccatattaattcatgtccaaaaaatagttctcagaatatccaaataattaaaggaagaatcaaagaggactagaggggttcagagrcagggaaggactctagtatgtaaaggtaattgcctggatgcttttccttgatgcttttcttcaatgatagaaaattcttacatcctatatatagagcaacaagctcttactagggaatgatgataataagttttctgttgctctctttgtgacattattaatgcaaagaagaaattattttaaagtaggttggaagagtgtgtagtgaggtaaaccataatggtttgatttgagcattggtactagagtcacaaaatcccaatttagagctagattattttactgtggctttaagcaaac

SEQ ID NO: 78141 - DNA, 601 bp, Human
aaattcttacatcctatatatagagcaacaagctcttactagggaatgatgataataagttttctgttgctctctttgtgacattattaatgcaaagaagaaattattttaaagtaggttggaagagtgtgtagtgaggtaaaccataatggtttgatttgagcattggtactagagtcacaaaatcccaatttagagctagattattttactgtggctttaagcaaactttttttctattttatttttatttttattttttaatttttgagacagggtcttgctctgtcacccaggctgsagtgcagtggtgcaatcgtggctcactgtagcctcgactcctcctgggctcaaacgatcctcccacctcagcctccagagtagctgggaccacaagcatgtgccaccatgcacagctaagttgttttttttttttttttgtatggggtcttgctatgttgcccaggctagtctcaaactcaggactcaagggatcatcccacctcagcctccagagtagctgggaccacaggtgtgtgccaccatgcatggctaattttttttttgaatgaggtctcgctctattgcccaggcagctcac

SEQ ID NO: 78142 - DNA, 601 bp, Human
tatagagcaacaagctcttactagggaatgatgataataagttttctgttgctctctttgtgacattattaatgcaaagaagaaattattttaaagtaggttggaagagtgtgtagtgaggtaaaccataatggtttgatttgagcattggtactagagtcacaaaatcccaatttagagctagattattttactgtggctttaagcaaactttttttctattttatttttatttttattttttaatttttgagacagggtcttgctctgtcacccaggctggagtgcagtggtgcaatcrtggctcactgtagcctcgactcctcctgggctcaaacgatcctcccacctcagcctccagagtagctgggaccacaagcatgtgccaccatgcacagctaagttgttttttttttttttttgtatggggtcttgctatgttgcccaggctagtctcaaactcaggactcaagggatcatcccacctcagcctccagagtagctgggaccacaggtgtgtgccaccatgcatggctaattttttttttgaatgaggtctcgctctattgcccaggcagctcacaaattcagcactcaggga

SEQ ID NO: 78143 - DNA, 601 bp, Human
gacattattaatgcaaagaagaaattattttaaagtaggttggaagagtgtgtagtgaggtaaaccataatggtttgatttgagcattggtactagagtcacaaaatcccaatttagagctagattattttactgtggctttaagcaaactttttttctattttatttttatttttattttttaatttttgagacagggtcttgctctgtcacccaggctggagtgcagtggtgcaatcgtggctcactgtagcctcgactcctcctgggctcaaacgatcctcccacctcagcctccagrgtagctgggaccacaagcatgtgccaccatgcacagctaagttgttttttttttttttttgtatggggtcttgctatgttgcccaggctagtctcaaactcaggactcaagggatcatcccacctcagcctccagagtagctgggaccacaggtgtgtgccaccatgcatggctaattttttttttgaatgaggtctcgctctattgcccaggcagctcacaaattcagcactcagggatcctcccaccttggcctcccaaagtgttgggattacaggcacgagccacggtgcctggttc

SEQ ID NO: 78144 - DNA, 601 bp, Human
ttcttagctgatgtaatatgtggtgaacacttttgtcctctagaccaggggtccctgaccctcaggctgaggaccagtactgacctgtggcctgttaggaactggggaggaccagtactgacctgtggcctgttaggaggaaccgggctgcacagcagggagtgagcagccactgtgtgagcattacctactgcctgagctccgcctcctgtcacatcagcagcagcattagattctcatagattctcacagagcgcaaactccattgtgaactctgcatgcaaggggtctaggatgtgcrctctttagaagaatctaatgcctgaggatctgaggtggaatacttcacctggaagccacctgcccccaccaatgccgcccgcactccgtctgtggaaaaattgtcttccacaaaagcagagcctggtgcctaaaaggttagggactgctgctctagaccccttcttgcccgacctgagtctgtgactttgccctgaactcctggcttcaaagggtcgcacaataggaaagacaggactgtgggaacctactgtctggagcctcatttttattgaaaatttctgatccgctttccaggaat

SEQ ID NO: 78145 - DNA, 601 bp, Human
gctgatgtaatatgtggtgaacacttttgtcctctagaccaggggtccctgaccctcaggctgaggaccagtactgacctgtggcctgttaggaactggggaggaccagtactgacctgtggcctgttaggaggaaccgggctgcacagcagggagtgagcagccactgtgtgagcattacctactgcctgagctccgcctcctgtcacatcagcagcagcattagattctcatagattctcacagagcgcaaactccattgtgaactctgcatgcaaggggtctaggatgtgcgctcttyagaagaatctaatgcctgaggatctgaggtggaatacttcacctggaagccacctgcccccaccaatgccgcccgcactccgtctgtggaaaaattgtcttccacaaaagcagagcctggtgcctaaaaggttagggactgctgctctagaccccttcttgcccgacctgagtctgtgactttgccctgaactcctggcttcaaagggtcgcacaataggaaagacaggactgtgggaacctactgtctggagcctcatttttattgaaaatttctgatccgctttccaggaatgatttt

SEQ ID NO: 78146 - DNA, 601 bp, Human
agcagcactctccaaagtgccaggtgtatgtagttccccgggaacacttaatttcagaaactctaattacacagctttatgttccagagtgtttccaagccggtgcatttgtctgtgtatatgttgttgttttgtcttgagacagaaattagtcaaattctttggttattttccttatgggctagttcttgttgatattaaccagtgttatttgtagctcagcgctttatgtaggataaactttaataaaagtcttgattgacatacttgactatgactaaattatatttactttcaaatkttttattttttatttatttttattttttgagacagagcctcgctcttattgcctaggctagagtgcagtggcgtgatgtcggctcactgcaacctcctcctcctgggttcaagcagttcttctgcctcagcctcccgagtagctggtgctacaggcacctgccaccacacctggctaattttttgtatttttgtagagacggggtttcaccatgttggccaggctggtctcaaactcctgacctcatgtgatccacccacctcggcctcccaaagtgctgggattgcaggcatgagccac

SEQ ID NO: 78147 - DNA, 601 bp, Human
gccaggtgtatgtagttccccgggaacacttaatttcagaaactctaattacacagctttatgttccagagtgtttccaagccggtgcatttgtctgtgtatatgttgttgttttgtcttgagacagaaattagtcaaattctttggttattttccttatgggctagttcttgttgatattaaccagtgttatttgtagctcagcgctttatgtaggataaactttaataaaagtcttgattgacatacttgactatgactaaattatatttactttcaaatgttttattttttatttatwtttattttttgagacagagcctcgctcttattgcctaggctagagtgcagtggcgtgatgtcggctcactgcaacctcctcctcctgggttcaagcagttcttctgcctcagcctcccgagtagctggtgctacaggcacctgccaccacacctggctaattttttgtatttttgtagagacggggtttcaccatgttggccaggctggtctcaaactcctgacctcatgtgatccacccacctcggcctcccaaagtgctgggattgcaggcatgagccaccttgcctggccttatttt

SEQ ID NO: 78148 - DNA, 601 bp, Human
cctggccttatttttatttttttgagacagtgtctcactctgtcacacaggctggagtgcagtggtgcgatcttggctcgttacaacccccacctcccgggatgaagtgattctcttgccctggcctcccaaggagctgggattacaggcatgcccggctaatttttatatttttagtagagacagggtttcgccatattggccatgctggtctcaaactcctgacctcagatgatccacctgccttggcctcccaaagtactgggattacaggtgtgagccaccatgtccagcccctacwttcaaaaattttaattaaatctttaatatggtagttaactatcatgcacatacagttccatttacaagaagagaaaccaacgtaaaataattagattcatctacttgatttcaatataatttattttttagtttgatagttattcataacagagatcacctgttctgaatttaatcatctgtacccacttttcctgttacatgttatgttgtccatgtaataggatgaatggtgtaggtaaatgaagacaaaatgcagactatttaactttagttcttgcttataagactggtggaatgt

SEQ ID NO: 78149 - DNA, 601 bp, Human
taatttattttttagtttgatagttattcataacagagatcacctgttctgaatttaatcatctgtacccacttttcctgttacatgttatgttgtccatgtaataggatgaatggtgtaggtaaatgaagacaaaatgcagactatttaactttagttcttgcttataagactggtggaatgtagatgacagctagtagcttaaataaaaatttgaaatgatttatagaatgtgggtttaaattgcttatgtaacccttattacctttgccatgtttaattcagccattaaaatttggcygagttacttgctgatattacagatttttcctcatagtaaaactttgtgttcatgactgtaagaaaatatttttataggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatggtaagtgacaccaaacatgagtagaaattaaattataaatccaccttttatatcatcctc

SEQ ID NO: 78150 - DNA, 601 bp, Human
gatttttcctcatagtaaaactttgtgttcatgactgtaagaaaatatttttataggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatggtaagtgacaccaaacatgagtagaaattaaattataaatccaccttttatatcatcctctagtcacccttgatttaatgcmtattttagtaatagtctttaaaatattttaaataaccttttacagattattaatactttattttgaaagactattttaggaaagtgttttcagagtgttctaaaatcagaagaaaaagtgggaaattgtgtttatacatttttatatattacaagagctaatttccttaatgcatttagaattcctgataaacagtaggaataaaggcaaagactataaaaaggaaatacaaatattatgtaataaatgtaataatttatataatataaaaaatcagctatatctgattttttttttttt

SEQ ID NO: 78151 - DNA, 601 bp, Human
attaatttttttgagatggagtctcgctccgtcgcccaggctggagtgcaatggcatgatcttggctcattgcaacccctgcctcccaggttcaagcaattctgcctcagcctcccaagtagctgggattgcaggtgtgtgccatcacatccagctaatttttgtatttttagtagagacggggtgtcaccatgttggcctcctggtcttgagctcctgacctcagataatctgcttgccccggcctcccgaagtgctgggattacaggtgtgagtcaccgcgcccggccattaatcaggytttttgtttttgttttttgagacggagtcccgctctgtggcccaggctataatgcagtggcgcgatctctgttcactataacctctgcctcctgggttcaagcgattctcctgcctcagcctcctgagtagctgggactacaggcatccgcccccacacctggctaatttttgtatttttagtagagacgaggtttcactatgttggccggctggtctcgaactcctgagctcgtgatccacctgccttggcctcccaaagtgctgggattatagacacgagccaccacccttggccccg

SEQ ID NO: 78152 - DNA, 601 bp, Human
cggggtgtcaccatgttggcctcctggtcttgagctcctgacctcagataatctgcttgccccggcctcccgaagtgctgggattacaggtgtgagtcaccgcgcccggccattaatcaggctttttgtttttgttttttgagacggagtcccgctctgtggcccaggctataatgcagtggcgcgatctctgttcactataacctctgcctcctgggttcaagcgattctcctgcctcagcctcctgagtagctgggactacaggcatccgcccccacacctggctaatttttgtatttktagtagagacgaggtttcactatgttggccggctggtctcgaactcctgagctcgtgatccacctgccttggcctcccaaagtgctgggattatagacacgagccaccacccttggccccgtgttttttacagcaacattaatttcatagatccagggcaatgtagtcaaaacccaataatttcattttaattccgaaagtcactgtcttgaagagtatgatggaaagactttaatgaccagcaagacttattgtaaaacctatagtaattaagacagtgaggcattggtacaaggacag

SEQ ID NO: 78153 - DNA, 601 bp, Human
ctgagctcgtgatccacctgccttggcctcccaaagtgctgggattatagacacgagccaccacccttggccccgtgttttttacagcaacattaatttcatagatccagggcaatgtagtcaaaacccaataatttcattttaattccgaaagtcactgtcttgaagagtatgatggaaagactttaatgaccagcaagacttattgtaaaacctatagtaattaagacagtgaggcattggtacaaggacagacagatatcctaataaaataagagatcctagaaacaacccaagcatrtgtggccacttgatgtaagaccaaggtggcgctgcagagcggcaggtaaaagatggtcttttcaacacgcattgctcagtcaattggatatccatttcagaagaaaatgaaatttgatcactacctcaagataccatatacaaaatcaattcactattgagttttttctctaaatgtacaaggtaaaaaaataacacttctagaagataatatagaagaatatcttcataaccttgagacagggaaagatattttaaataggacacaaaaagccctaaccacaaaggaacgattgatcca

SEQ ID NO: 78154 - DNA, 601 bp, Human
gaccagcaagacttattgtaaaacctatagtaattaagacagtgaggcattggtacaaggacagacagatatcctaataaaataagagatcctagaaacaacccaagcatatgtggccacttgatgtaagaccaaggtggcgctgcagagcggcaggtaaaagatggtcttttcaacacgcattgctcagtcaattggatatccatttcagaagaaaatgaaatttgatcactacctcaagataccatatacaaaatcaattcactattgagttttttctctaaatgtacaaggtaaaaawataacacttctagaagataatatagaagaatatcttcataaccttgagacagggaaagatattttaaataggacacaaaaagccctaaccacaaaggaacgattgatccagtgaactacattaaaatgaaaaactttggattattaaaaggccattaagagggaggaagattgcttgagctcaggagtacaagaccagcctgggcaacatgacagtatcccatctctgcaaaaaaatacaagcattagccaggcggggtggtgtgcacctgtggtcccatctacttgggaggctgaggtg

SEQ ID NO: 78155 - DNA, 601 bp, Human
tgtatacttttctgtatatgtatgatgctttaatgaaacgtttaaaattaaacctactacactgagagatcattattcacctcccagtgttagagatcaaaacatttggcaacacattgttggcaaaggaactctctgctgttggcagctgtggttagaaggatctgtctacaagattaaactttgacacagtaacctcacttttgggaacttatattgcatatattcttgctcatgtataagattattgattgcaacattgcaatatcaagagactggaaaccacctaaatttccatcarttgttaagaaattatatccacataatggagtactgtgcagctgtaaaatacatagaaatgctttgtgtactgataggaaaagaccactaagttaaaatgtgttctgaagctacaaataatatacaaaatacagtacactgtattaaaaggggcaaagggaagaatatatgtattcacttgaatttgcacaaaatatctttgggaagatgttaaataaccacatccctttcctgtggggagaggggcttgggtggctgggaggtgggcatgggggacttttctctgggtgctctgcacttg

SEQ ID NO: 78156 - DNA, 601 bp, Human
taagaaattatatccacataatggagtactgtgcagctgtaaaatacatagaaatgctttgtgtactgataggaaaagaccactaagttaaaatgtgttctgaagctacaaataatatacaaaatacagtacactgtattaaaaggggcaaagggaagaatatatgtattcacttgaatttgcacaaaatatctttgggaagatgttaaataaccacatccctttcctgtggggagaggggcttgggtggctgggaggtgggcatgggggacttttctctgggtgctctgcacttggatcygtatattgtactcctgcacttggatccatatattacctaataaatgaaaatatttgggagttaaccctcagatgtctttttcctctcagacatggcaaatatgtacgtcttactccgtgctgtgtccactggtttacctcatatgattcaggagctgcaaaaccacatccatgatgagggccttcgagcaaccagcaaccttactcaggaaaacgtgagttgtgtgggaaactgcaacgttttcctcctaatcagatccagcgtggagcctttcctttgactttattgttttgaaagatg

SEQ ID NO: 78157 - DNA, 601 bp, Human
tttgcctcctttccatatcctctgaatttggttgtccaggaagcaaatttagattaaaataatcttctgtaagtatatgcttgctgccccaaatacctaaaacaataaccctcatatccctaatactcatctttctcgaatactttgccaatcacatgactgtaacagtttgtactgtaacagtttgtctttcccatcaccaaatcttgttattactggtaatgtttgatgagcaagagagaaataacttcaaatgttactgtctcttcttaagtagagctgtttgcccttcatctataaratagtatctgtgtatagacgtcactgttcaggagcactttttagaggctgttaccttagctgcagattggtttttggcaagtaataatttttagtttttatgttatgccacaataatgtgtaagttttctatttttttatttcttcaaattccctttaccacagttttctattttttgtagaactattagtttatagtattcaggtttattactctattatttgtcaaacttactagtttacattattacgtttatagattccatgtccaatgacattgggcatagaagcatcgaatttt

SEQ ID NO: 78158 - DNA, 601 bp, Human
agtgtgcatgtgtgaaacataatttccttgaggaaaaatttactaataagtctaataaacctcatagtttggatatccttgaacctcttaaaatgtggttttgtacttatatttcatttttagatgccaacactatttgtggagtcagttttggaagtgcatggtaaatttgttcagcttatcaacactgttttgaatggtgatcagcattttatgagtgcgttggataaggtaagttttaaatacatatatactatatatgtacataaaactctatcattctttaggcagtttcaagatyagaattctagtatgaggtttctgatgtagacatggagattaagtaattttgatatgaaattcaaaatagaaataatataatttttaaattattaactgaatagttaaattgaatgcttgtagaatgtcccgtgattatgctatataaggggaatttttaatctgatatgttctggatagacatgcataattttgcaatttttagtactgattttttttctttggccataatacttaggctatattgaataatatttgaaaagagaatagatatgttttacatgaacttttgcatacgtta

SEQ ID NO: 78159 - DNA, 601 bp, Human
tgtaaggaatgcaatatactatgtgtcttaaagaataaccattttacaaagtttgggttttaatgtatatctactttgaaataatttgcaatacttttcatgtagattctgttacatctgaaatctaaaggaaatctgatgataaagtttgggtaacctttgaaggaaacttgcttacaagatttttgtaacttttttttaaagtacttgttcaatgtcaaaaattataaaaccactcgaaactcacctaggtgttcttttaaaaatttgtattacttatatcagttgctttattggtcartaagtgatgatttgatatttgacttgttctttttaaaaatttaccttatgatgtatattttatttagtttacatttatgattattacataaagctttagaagcctggtgtggttgtgcatgcctgtagtcccaactacttgggaggctgaggcaggaggatcctttgagcctaggagtttgaggctgcagtgagctatgatcttgtccactgcaatccagcctggcaacagagcaagacccggtctctaaaaaaaacagcaaaaattctgtccgctgatcttaccttgtatcaccacttt

SEQ ID NO: 78160 - DNA, 601 bp, Human
agcaagacccggtctctaaaaaaaacagcaaaaattctgtccgctgatcttaccttgtatcaccactttgcctcctttgaggcgtgatatatacagaagcaccctttgtaagatttattatcaatttctacatgagcttgctaagtactgtgacaacttactgaagaagtcagcgaaagggatgacagagaatgaagtggaagacaggctcacgagcttcatcacagtgttcaaatacattgatgacaaggacgtctttcaaaaggtatgttgtgaacagaaaagtttcatttgtattttrgtcaactttatttctgaatgctaaatcattagaaaggaagtaatcttttaaaatatttttaaatgtagttctacgcaagaatgctggcaaaacgtttaattcatgggttatccatgtctatggactctgaagaagccatgatcaacaaattaaaggtaatgtaagtctttaatgtggtattgtcctagaaattcattcacaagcacataaagatgttcattgcagcattgtgtacagtaacaggaaacaattcatctggttaaatgtgtatttgtgtagtcacacagtgggatatacaaa

SEQ ID NO: 78161 - DNA, 601 bp, Human
caaaaattctgtccgctgatcttaccttgtatcaccactttgcctcctttgaggcgtgatatatacagaagcaccctttgtaagatttattatcaatttctacatgagcttgctaagtactgtgacaacttactgaagaagtcagcgaaagggatgacagagaatgaagtggaagacaggctcacgagcttcatcacagtgttcaaatacattgatgacaaggacgtctttcaaaaggtatgttgtgaacagaaaagtttcatttgtattttggtcaactttatttctgaatgctaaatcrttagaaaggaagtaatcttttaaaatatttttaaatgtagttctacgcaagaatgctggcaaaacgtttaattcatgggttatccatgtctatggactctgaagaagccatgatcaacaaattaaaggtaatgtaagtctttaatgtggtattgtcctagaaattcattcacaagcacataaagatgttcattgcagcattgtgtacagtaacaggaaacaattcatctggttaaatgtgtatttgtgtagtcacacagtgggatatacaaatactgtattaaaaggacaaaatgtatat

SEQ ID NO: 78162 - DNA, 601 bp, Human
tttatatatgaagattcacaagataatcagtattaatgataaaagattattactacttataaatgaatacacctaaaatattcctttaagtacagattttggagtgcaattccatttcaatttatttttacatcatttcagcttgcttacataccgataagtggtagcaggttcatatttatcctgtgttattcaataaattttcttgcatagtagacattttgaatataatatgcattccttttttcctttttctttttttaagagatagggtctcactatgttgcccaggctggactcwaactcctgggctcaagcgatcctcccgcctcagcctcctgagcagctgggacaataggtgtgcaccactgcacccagttgctgtgtgctcttttttaaacctccaaaaagaaacttaatttttaatttctaaaagtagtgttggccaggtgtggtggttcatgcctataatagtagcactttgggaggccaaggcatgtagattgtttgagctcagtagttcaagaccagcctgggaaacatggcaaaaccctgtctctaccaaaaatacaaaagttagctgggcttggtggcgtgttcc

SEQ ID NO: 78163 - DNA, 601 bp, Human
tcctcccgcctcagcctcctgagcagctgggacaataggtgtgcaccactgcacccagttgctgtgtgctcttttttaaacctccaaaaagaaacttaatttttaatttctaaaagtagtgttggccaggtgtggtggttcatgcctataatagtagcactttgggaggccaaggcatgtagattgtttgagctcagtagttcaagaccagcctgggaaacatggcaaaaccctgtctctaccaaaaatacaaaagttagctgggcttggtggcgtgttcctctagtcccagttactcagrtggctgaggtgggaggattgctggagcctgggacatcaaggctgctgtgagccatgatcataccactgcactccatcctgagtgacagagcaagatcctgcctctaaatagattaattacaaaaaaaaagtagtgttaatgagctttttatatttcaagattagagattcagattttctgacctggtaacaacagaattttgaataattttaaagaaatagttttcttcagcactcagtagatgctattaaaaatatgcctaaatagaactttttcaattgactacaggctggagtattc

SEQ ID NO: 78164 - DNA, 601 bp, Human
agtttaccagcaagctacatcggatgtatacagatatgagtgtcagcgctgatctcaacaataagttcaacaattttatcaaaaaccaagacacagtaatagatttgggaattagttttcaaatatatgttctacaggtatgaatatgtgttttactatgagcatttactaatcatttcagtacgttgatacaaatgattcataaatggatgcctgattacgtttggttctgtgagtagattgtggcttctaaagtcctattgatttgggctgggcgtggtggcttatgcctgtaatcccrgcactttcagaggccaaagcaggcagatctcttgagctcaggagttccagaccagcctggccaacatgtgaaaacccgtctctactaaaaatgcaaaaattagccaggtgtggtggtgcgtgcctgtaatcccagttactggggaggcagaggcaggagaattgcttgaaccccagaggcggaggttgcagtgagcggagatcgtgccactgcattgaagcctgggtgatggagtgagactccatctcaaaaaaaaaaaacaaaaaaaggtcctattggtttggaatgaaatgtgccatg

SEQ ID NO: 78165 - DNA, 601 bp, Human
atcttaattgttacatttcttttttacctaggccaaaaacctgaataatattagaagtatctaaagttgccgggcgcggtggctcacgcctgtaatcccagcaccttgggaggccgaggcgggcggatcatgaggtcaggagattgagaccatcctggctaacacagtgaaaccccgtctctactaaaaatagaaaaaattagccgggcatggtggcatgcacctgtagtcccagctactctggaggctgaggcaagagaatcggttgaacccaggaggtggaggttgcagtgagccgagwttgcgccactgcactttagcctgggtgatagagcgagactccgcctcaaaaaaaaaaaaaaaaaaagtatctaaagtagtgtatattaatgtagctatctattaaaggtaaataaactcattgaatttttaaggctctttgagatctaattaatgcccttaaacagtgtttgaaaaatgctgttttttatcctgtttattttaaaataagtttagtctgggaggaggggggagggatagcattaggagatatacctaatgctaaatgacgagttagtgggtgcagcacaccagcatggca

SEQ ID NO: 78166 - DNA, 601 bp, Human
ttgccgggcgcggtggctcacgcctgtaatcccagcaccttgggaggccgaggcgggcggatcatgaggtcaggagattgagaccatcctggctaacacagtgaaaccccgtctctactaaaaatagaaaaaattagccgggcatggtggcatgcacctgtagtcccagctactctggaggctgaggcaagagaatcggttgaacccaggaggtggaggttgcagtgagccgagtttgcgccactgcactttagcctgggtgatagagcgagactccgcctcaaaaaaaaaaaaaaaaaaagtatctaaagtagtgtatattaatgtagctatctattaaaggtaaataaactcattgaatttttaaggctctttgagatctaattaatgcccttaaacagtgtttgaaaaatgctgttttttatcctgtttattttaaaataagtttagtctgggaggaggggggagggatagcattaggagatatacctaatgctaaatgacgagttagtgggtgcagcacaccagcatggcacatgtatgcatatgtaactaacctgcacattgtgcacatgtaccctaaaacttaaagtataataat

SEQ ID NO: 78167 - DNA, 601 bp, Human
ataattacactgtttataatcttgctgcttttaaagaaatgttctgactttatactgatttattacatttctctagccaaccacttcattagcaaatgtatttagaaactcacatttgatggggcagacacacttagaaacttgttctctaagtatgccagatcctcttgccagtttctttattatagcatcataaggagacctaaccatttgatttttacttgtgatactgcagtgaatgcaatagtaaagctttttgcagaaagtcctacttaattttcaatagtttccaattttaaawaacttttatcacaatctaatttcctttgcttctttctggaacaatggagtccacttacttacagtaggattaatacctgaattattgtggactgtgtgtggagttgcctgaagatgtaagccaaagcagacacttgaattttctctttttttgctaaactatgctttgacaagttcattgaatcactttttctttgtacaagaaggaaagggtatatatgctaatatttcttagagatggtacaagaaaatcatttgccataacctttattaggaaatgttttctatcccctccccaaga

SEQ ID NO: 78168 - DNA, 601 bp, Human
cccctccccaagagttactttatccaagtaactatgatacttggtgtttatttgactaatttacatcttgggaacgtgatggctcattgtattagtaatacattttgcattacttatataagtcgatctttactgagcaagttggacattctaatttttaaaataatttttgaaatgagattttttactgatactcttagtggtagtcaaaggtcaaattttaatttgacttttggctaggtgcagtggctcacacctgtaaccccagcacttggggaggctgagacaggtgggtcacttratcccaggagtttgagaccagcctgggcaacatgacaaaacctgtctctactaaaaaatccaaaaattagccaggcgtggtggagcacacctgtagtcccagctactcgagaggctgagatgggaggatcacttgagcccacgagctggaggctgcagtgagccatgatcgtgccactgcactccagcctgggcaacagagcaagaccctgtctcaaccagtcaatcaatatgttctattttcatttagtaaacataattgattttaagaaaaaaatgctggaccagggttttagatttt

SEQ ID NO: 78169 - DNA, 601 bp, Human
tttatccaagtaactatgatacttggtgtttatttgactaatttacatcttgggaacgtgatggctcattgtattagtaatacattttgcattacttatataagtcgatctttactgagcaagttggacattctaatttttaaaataatttttgaaatgagattttttactgatactcttagtggtagtcaaaggtcaaattttaatttgacttttggctaggtgcagtggctcacacctgtaaccccagcacttggggaggctgagacaggtgggtcacttaatcccaggagtttgagamcagcctgggcaacatgacaaaacctgtctctactaaaaaatccaaaaattagccaggcgtggtggagcacacctgtagtcccagctactcgagaggctgagatgggaggatcacttgagcccacgagctggaggctgcagtgagccatgatcgtgccactgcactccagcctgggcaacagagcaagaccctgtctcaaccagtcaatcaatatgttctattttcatttagtaaacataattgattttaagaaaaaaatgctggaccagggttttagattttttttttttcccctaagaa

SEQ ID NO: 78170 - DNA, 601 bp, Human
agtttgagaccagcctgggcaacatgacaaaacctgtctctactaaaaaatccaaaaattagccaggcgtggtggagcacacctgtagtcccagctactcgagaggctgagatgggaggatcacttgagcccacgagctggaggctgcagtgagccatgatcgtgccactgcactccagcctgggcaacagagcaagaccctgtctcaaccagtcaatcaatatgttctattttcatttagtaaacataattgattttaagaaaaaaatgctggaccagggttttagattttttttttttyccctaagaaaactaatatatcttagtgcagttcgatttagcttgcttttactttccatgaatatctgtctgggggagtttaaacattcttggttattctcattatttcagcaataatcaatgtgtctcctaaagtaattttagtaaggggctcattttaacaaccagtggtgtataagaagaaaataaatttatgcacatagttttttagccattggaatttagtttgaaaatagtcaccaatatcacctaaataggaaagagaataactttctttctgtttttgagctatactaaattt

SEQ ID NO: 78171 - DNA, 601 bp, Human
tgttggccaggctggtctcgaacgcctgacctcgtgatccacccacctcggcctcctaaagtgctgggattacaggcatgagccaccgtgcccagccttgtcacagtaattttcaagtttactccacagtagattaacagtcaccatgctatatgatagatctccagaacttactggtcctaactgaaactttgtcccctttgatcaacatttttcattttatttttgttctccatttattcatttaacaaaaagtttctcacacgctatgtgtattgaagatacttgttctagattaccyatatatggcctaaggctccaggacttctttaaaacactggctctgaggctggacagatctctcagagttctgtttcttgagaacccctgttacttctgcttaaacatagaatgaaaattattcttgcctagtctatttctacattcccagctcatggaatacccaagaaaaggttaatttttgtattgtaaatgaagagtcttcacaaatggttgatggtgcacaaggtggtgtttgggggaatttagaatcagaagacctgtggctggagttattagctcacaacttattagctgtgta

SEQ ID NO: 78172 - DNA, 601 bp, Human
tgtattgtaaatgaagagtcttcacaaatggttgatggtgcacaaggtggtgtttgggggaatttagaatcagaagacctgtggctggagttattagctcacaacttattagctgtgtaatcttaagcaaattacttaactcctttgagcctgtttccttctctttattgttgtaaaattcattgatcaactcaaagaacattttctatgtctcaggtacttctaaacgccaagtggacagaaataaaatacagagccttggccctcaaaaaaaactcatgtctagtaggaagacagacatacgtacatagttacagtacggtgttttgaatgtgatagaggccagcccagggcatatcacagaatggtggtggcagtcaggtccttgcgagggaagtcttctggggaaatcacatctcaacttgttttcaagagctaatagggccgggtgccccctcgccccacttcgccccacctcaccccacctcaccccacctcaccccacctcaccccaccccacctcacctcacctcacctcacctcacctcgcctcacctcaccccacctcgcctctcctcaccccacctcacgtaagctggag

SEQ ID NO: 78173 - DNA, 601 bp, Human
tattgtaaatgaagagtcttcacaaatggttgatggtgcacaaggtggtgtttgggggaatttagaatcagaagacctgtggctggagttattagctcacaacttattagctgtgtaatcttaagcaaattacttaactcctttgagcctgtttccttctctttattgttgtaaaattcattgatcaactcaaagaacattttctatgtctcaggtacttctaaacgccaagtggacagaaataaaatacagagccttggccctcaaaaaaaactcatgtctagtaggaagacagacatacgtacatagttacagtacggtgttttgaatgtgatagaggccagcccagggcatatcacagaatggtggtggcagtcaggtccttgcgagggaagtcttctggggaaatcacatctcaacttgttttcaagagctaatagggccgggtgccccctcgccccacttcgccccacctcaccccacctcaccccacctcaccccacctcaccccaccccacctcacctcacctcacctcacctcacctcgcctcacctcaccccacctcgcctctcctcaccccacctcacgtaagctggagtg

SEQ ID NO: 78174 - DNA, 601 bp, Human
ccaccccacctcacctcacctcacctcacctcacctcgcctcacctcaccccacctcgcctctcctcaccccacctcacgtaagctggagtggaggtgcgcgatcacagcccacattagcctctgcctcccgggcttaagagatccctgtagtcccagctacttgggaggctgaggtcaccagagcccagagtgagaagaccaggcaggcccaaaaagaaaataaataaatgaaaataaaaaataataaatgaaagaaggaaggaaggaaggatatacatgtatatgtaaatgaaatgggkttttatttaatacatattcatacattaaaattgacattaatataaacatgtattaattatggaaatatcatctatatagttttatcactacatatttgtgtgtgtgtatgtatgtgtgtgtgtgtatatatatacatacatatataaaaaaatgtatgtttatacacagcagtgtgcagaaaataagattctctgaggcaggagaatggcatgaacccgggtggcggagattgcagtgagccgagatcacgccactgcactccagcctgggcgacagagcaagactccgtctcaaaaaaa

SEQ ID NO: 78175 - DNA, 601 bp, Human
atttaatacatattcatacattaaaattgacattaatataaacatgtattaattatggaaatatcatctatatagttttatcactacatatttgtgtgtgtgtatgtatgtgtgtgtgtgtatatatatacatacatatataaaaaaatgtatgtttatacacagcagtgtgcagaaaataagattctctgaggcaggagaatggcatgaacccgggtggcggagattgcagtgagccgagatcacgccactgcactccagcctgggcgacagagcaagactccgtctcaaaaaaaaaaaagaaagaaagaaagaaagaaaacatgctgcagattaacatggaggttaatttaatctgcagttagaatggaataaaattgtcaccatgtccatggcttgcagagactgtaatgtgctccctacaaagtcttctgttgaagctctaacccctaaggtccatgagaaggtgatcaaggttaaataaggtcatagtaatctagcactgtgggaggctgaggcaggagtatcacttgagcccaggagttcaagatcagcctgggcaacatagtgagaccctgtcttgaaaaaaaaaaaaaaaaac

SEQ ID NO: 78176 - DNA, 601 bp, Human
cataaaataaaaagaatgaataggacttaaccaagctacgtaaaggagagtgttgagagtgtatttccaacagaggaagaattttaagaagcaatctgtgatgccagatgtgacagagtgagaaaaatcctgaaaattccactggatttatgactaaggctttggatagaattaacgataaggaacagtttgataaagacatacagatacttgataaagagatataaccagacagtgtgacagaaaccattacactgtctttgtataaataagttttatttgtggcagagcaagaagttgyagagattgctggtcagttgctgaaagacacgttgagaaatgatgaactcaaggaagataaaaaaaacttcaccaggcagtacatagtatggatcaggctagaattttgtgaaccctacatcatagtatgtgttggtagttactagtgtttgccagaataaaagtaacaccatatcattgtgcataccttaaaagataacgattctattgactaaatttgtcttgcttttgttttcaaataattccaacagctaaaaatagggagggatgttagtattgtctaatgtccagtccatattca

SEQ ID NO: 78177 - DNA, 601 bp, Human
aagaattttaagaagcaatctgtgatgccagatgtgacagagtgagaaaaatcctgaaaattccactggatttatgactaaggctttggatagaattaacgataaggaacagtttgataaagacatacagatacttgataaagagatataaccagacagtgtgacagaaaccattacactgtctttgtataaataagttttatttgtggcagagcaagaagttgtagagattgctggtcagttgctgaaagacacgttgagaaatgatgaactcaaggaagataaaaaaaacttcaccagrcagtacatagtatggatcaggctagaattttgtgaaccctacatcatagtatgtgttggtagttactagtgtttgccagaataaaagtaacaccatatcattgtgcataccttaaaagataacgattctattgactaaatttgtcttgcttttgttttcaaataattccaacagctaaaaatagggagggatgttagtattgtctaatgtccagtccatattcaaatttccctgactgtcccaaggtgacttgcttgactgtcagaggtcactaattgtatttggttgttacatttccct

SEQ ID NO: 78178 - DNA, 601 bp, Human
tataaccagacagtgtgacagaaaccattacactgtctttgtataaataagttttatttgtggcagagcaagaagttgtagagattgctggtcagttgctgaaagacacgttgagaaatgatgaactcaaggaagataaaaaaaacttcaccaggcagtacatagtatggatcaggctagaattttgtgaaccctacatcatagtatgtgttggtagttactagtgtttgccagaataaaagtaacaccatatcattgtgcataccttaaaagataacgattctattgactaaatttgtcytgcttttgttttcaaataattccaacagctaaaaatagggagggatgttagtattgtctaatgtccagtccatattcaaatttccctgactgtcccaaggtgacttgcttgactgtcagaggtcactaattgtatttggttgttacatttcccttccacctccccacttctcagcattctttgacacactgttttgaacagaccaggccagttgtcttgtagaatatccagtactttggattacttatttgtgatttattttttttttttttaaatttgttttctattccttgtatgttc

SEQ ID NO: 78179 - DNA, 601 bp, Human
agtcctttttatagaaattgttaatagtatactccaaatgataattttttgcacaagctgtttctatgaattggatattgaatttaatatattaaacctccttttgtgaaaatttagagggctatgaattttttctcttggtattcccatccagataattctgaaaaatgtttctaaatatcagttttatctgaaatgtcaaggcataaatgataataatcaagataatattgcatttatggtgatattaagctaatgaattcactcatagcctttaaaatctttttttttttttttttttgagacggagtttcgctcttgttacccaggctggagtgcaatggcgcgatctcggctcacagcaacctccacctcccgggttcaagccattctcctgcctcagcctccggagtagatgagattacaggcatgcaccaccacacccggctaattttgtatttttagtagagacggggtttctccatgttggtcaggctggtcttgaactccagacctcaggtgatccacctgcctcggcctcccaaagtgctgggattacaggcgtgagccactgcgcccggcctaaaatctttaatgaggt

SEQ ID NO: 78180 - DNA, 601 bp, Human
ttagtagagacggggtttctccatgttggtcaggctggtcttgaactccagacctcaggtgatccacctgcctcggcctcccaaagtgctgggattacaggcgtgagccactgcgcccggcctaaaatctttaatgaggtaatgaatacataaagcagaaaaccttaatcagagttactaattatccttgagagggaaaatgcagtctctggggtaattttatgagaaatacagcttccttgagttaacaatgaagagctttaaaatcaaatctcatgttgatttcatctttttttttttkttttttttttttttgtgagatggagtcttgctctgttgcccaggctggagtgcagtggtgcgatctcggctcactgcaagctccgcctcccgggttcacgccattctcctgcctcagcctcccgagtagctgggattacaggtgtccgccactgcgccctgctagttttttttttttttttgtatttttagtagagcaggggtttcaccgtggtctcgatctcctgacctcgtgatccgcctgcctccacctcccaaaatgctgggattacaggcgtgagccaccacgcctggcccaatt

SEQ ID NO: 78181 - DNA, 601 bp, Human
agagacggggtttctccatgttggtcaggctggtcttgaactccagacctcaggtgatccacctgcctcggcctcccaaagtgctgggattacaggcgtgagccactgcgcccggcctaaaatctttaatgaggtaatgaatacataaagcagaaaaccttaatcagagttactaattatccttgagagggaaaatgcagtctctggggtaattttatgagaaatacagcttccttgagttaacaatgaagagctttaaaatcaaatctcatgttgatttcatcttttttttttttttttktttttttttgtgagatggagtcttgctctgttgcccaggctggagtgcagtggtgcgatctcggctcactgcaagctccgcctcccgggttcacgccattctcctgcctcagcctcccgagtagctgggattacaggtgtccgccactgcgccctgctagttttttttttttttttgtatttttagtagagcaggggtttcaccgtggtctcgatctcctgacctcgtgatccgcctgcctccacctcccaaaatgctgggattacaggcgtgagccaccacgcctggcccaatttcatt

SEQ ID NO: 78182 - DNA, 601 bp, Human
attatccttgagagggaaaatgcagtctctggggtaattttatgagaaatacagcttccttgagttaacaatgaagagctttaaaatcaaatctcatgttgatttcatcttttttttttttttttttttttttttgtgagatggagtcttgctctgttgcccaggctggagtgcagtggtgcgatctcggctcactgcaagctccgcctcccgggttcacgccattctcctgcctcagcctcccgagtagctgggattacaggtgtccgccactgcgccctgctagttttttttttttttttgtatttttagtagagcaggggtttcaccgtggtctcgatctcctgacctcgtgatccgcctgcctccacctcccaaaatgctgggattacaggcgtgagccaccacgcctggcccaatttcatttataatccattcaacaatcaaataatgcaggccgtgtgtgtgttagtcgtcaaaccacaacttcgtgctttaggaagcagctctttgatctgcatcttttttcttttctttttttttttttttaaacacgtatggaacattacagagtgtagacatgtttgccatattattcatt

SEQ ID NO: 78183 - DNA, 601 bp, Human
tgggattacaggtgtccgccactgcgccctgctagttttttttttttttttgtatttttagtagagcaggggtttcaccgtggtctcgatctcctgacctcgtgatccgcctgcctccacctcccaaaatgctgggattacaggcgtgagccaccacgcctggcccaatttcatttataatccattcaacaatcaaataatgcaggccgtgtgtgtgttagtcgtcaaaccacaacttcgtgctttaggaagcagctctttgatctgcatcttttttcttttctttttttttttttttaaacacgtatggaacattacagagtgtagacatgtttgccatattattcattatgagctttcagtgtgctgatgtcatgctgctgtctcccaggatgttgcagaactgtagtatacataatacttgctctatctcttagagctcccagggtcatttagcatatagaattttttttttttttttgagacagatactcattctgtcgcccaggtttgagtgcagtggtgtgatcttggctcactgcaacttctgcctcccaggttcaaggattcttataccttagcctcccgagtagctgggttt

SEQ ID NO: 78184 - DNA, 601 bp, Human
caaaccacaacttcgtgctttaggaagcagctctttgatctgcatcttttttcttttctttttttttttttttaaacacgtatggaacattacagagtgtagacatgtttgccatattattcattatgagctttcagtgtgctgatgtcatgctgctgtctcccaggatgttgcagaactgtagtatacataatacttgctctatctcttagagctcccagggtcatttagcatatagaattttttttttttttttgagacagatactcattctgtcgcccaggtttgagtgcagtggtgygatcttggctcactgcaacttctgcctcccaggttcaaggattcttataccttagcctcccgagtagctgggtttacaggcatatgccatcatgcccggcgaatttttgtatttttagtagagacaaggtttcgccatgttgaccaggctggtctcgaactcctgggtttaagtgatctgcccacctcggcctttcaaagtgctgggattacaggcataagctaccgtgcccagcacatatagaacatatttatgaaaacattcagattaaatgtttttcatttttatgaaaacattcag

SEQ ID NO: 78185 - DNA, 601 bp, Human
atgaaaacattcagattaaacatttttatgaaaacattcagattcttttgctatcaactttcagcaagagaatgggtctgcctgtttgtctctcctttcatacctgtttgcctctaggaagttactggaaagaaaaatgttgtttatgagacataatagcattaattttggcagaaattacagcttagacagggcctcaaaagcattttccatgtggctgtggacctcccaggaggcttgaaccttacctgggagagcccagctatcgacagcacttgaggctgttgctgatatcactttsccctttgtctgtccatttctccttctcccacctccttttattgtttgggttttttgttcttttctttttctgcctaagtcttagcatttctattaatatttaaagacttttttttttgttttttttttttttttgagacagagtctcgctctgtcacccgtgctggagtgcagtggtgtgatcttggcttgctgcaacctccgcctcccaggttcaagtgattttcctgcctcagcctcccaagtggctaggattacaagcatgagccaccatgcctggctaatttttgtacttttagta

SEQ ID NO: 78186 - DNA, 601 bp, Human
aggacagcactcagatgaatgaaaaggaactgacaaaaacaatcaaatcattacttgatgtgaaaatgattaaccatgattcagaaaaggtatgtagtaatattccaaagaatttaagcatcatcagcattaaagctttttcatgagatgtttgcagttttaaaataaggctgtaattgttattgtgctctggaaagcacttgtattcactacgttactgtacgctccatagagctgcgagcgttaaggcatcacagagcatgctgtgtgagttggtgccatgtgccgtttatagtttgaktttatttgtcctatactgttacagcttattgaataattgtaaaagaattgccatctggaagattttgattaattgagattttgaaactagcctttaaagactttccaggtttttggttttataaatgtgcttaatttcatggttctataacaggaaatgacagcctgttgatgtctgtttgtacacatatttaatatgtgtaactccattccaagtgttcttaatgtcagcactcaattaactgtcatctgtttttaaccaccatatatttttaatatctgtcacaagaataacaagcca

SEQ ID NO: 78187 - DNA, 601 bp, Human
tgtaagccactatgccaggctaattttttaatttttagtagagaccgggttttgctttgttggccaggctggtctcaaactcctgagctcaagtaatctgcccacctcagcctcccaaagtggtgggattacagacgtgagccaccatgcctggcctttaaatttaattatgaatctgtccattccttagcagaatgtcttagattattattgagaattatttcatcttccaagtgccttttgattctgctgccagagaaattccactctatgatatcagtggctttcttaagcctgatayagaagttgttattctaaaaattgcctaaacagttttcccctgagcaaaggccacttgcttcttgaagagtgaataaaacatggattgaaataaatgttttcaccatcaccccaggtcacagcaaattgatgctgtgtgctactggaggcacagctttctcttgtcatcaggccatttacagtgggtattttgttactgcggcatttgtaaaaaaaaatgtggttgctttttcaaaatggggtgatggaaaagttacgcactttggtgtttcataaaaattaaaatgtcaaactctaggca

SEQ ID NO: 78188 - DNA, 601 bp, Human
gtagtgtatatagaatagtaggaccagaaaatagcttattcccaaacataaactgcttaagattctggcagatgtaaaagtagaaaataattgggttttttcctgtttgtttgaacaaaagaattatttttctcttaaatttggtaatctataatataaaagttatgagagtggaggcttttttgcttggtcattaatttagcagaattgcttgcagcaaactcttatttaaagattttggtttttataaatataaatgttttatttttaaatgtaggaagatattgatgcagaatcttcrttttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatt

SEQ ID NO: 78189 - DNA, 601 bp, Human
tgcagaatcttcgttttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatttgctcttaaaccattagaatgtgtaactatgcattctctccgaaaattcccacattgagaagtaataaaatttcatatttttcatttgtaaaataagggaaagttctccagttcatttttttttttttttttgagacggagtcttgctctctcgcccaggctggagtgcagtggtgtgatctcggctcactgcaagctctgcctcccgggttcacgccattctcctgcctcagcctcctgagtagctgggactacaggcgcccaccactatgcctggctaattttgtt

SEQ ID NO: 78190 - DNA, 601 bp, Human
aaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatttgctcttaaaccattagaatgtgtaactwtgcattctctccgaaaattcccacattgagaagtaataaaatttcatatttttcatttgtaaaataagggaaagttctccagttcatttttttttttttttttgagacggagtcttgctctctcgcccaggctggagtgcagtggtgtgatctcggctcactgcaagctctgcctcccgggttcacgccattctcctgcctcagcctcctgagtagctgggactacaggcgcccaccactatgcctggctaattttgttttttgtacttttagtatagacggggtttcactgtgttagcc

SEQ ID NO: 78191 - DNA, 601 bp, Human
tgaggaggggacttctgctcttcattattttaactcagcagtgattgttgctttggtctgggatagactgtttctatcacttatgcttcctgattgcctccggtgtgcagtccttgggctgatgcaggatgtgaagataatataagatgttagaccctctccagaaacttaattcccgatggggggagacaaatattaattgccatttactttgaaacctaaaatggtcaagattccattttcctccaggctaataaataataatttgcaatatatagattgtattttgtctttgaaacgstgtgaggagatcctcttaatgtggcatggtctgcttctatgccttgcttctgtgtttcttgagctccgtggagataggccccctctcctggcttctctgcttgagccacataaaatgccacttcacagctcttccctttgaagcctgatccagtatgcatttggagctaattactgcagttgacacaactccatctaaaagcgtcatgaaagattctgtaatcactgataagaaaatgatcttgcaaattattgctgtgtcctcctttattgcctctttaccttaacagtacagtttaca

SEQ ID NO: 78192 - DNA, 601 bp, Human
tgggtcttttttcttttcttctgtaaaacaggaaatggagcagactagaagtgcagttgatgaggaccggaaaatgtatctccaagctgctatagttcgtatcatgaaagcacgaaaagtgcttcggcacaatgcccttattcaagaggtaaaaggagggcagtcctcagggcttcttagggtagagggcattgtcattgtacagattcagtctctttcttcttaaagaggatacagaaataacctgatcctcagatagcataaagaaatgtttcatacttaatcagaatcgtactcactyacaatttcagtattaaattcagatttgcaggctgggcacagtggctcatgcctgtaatcctttttgttgttgttgttgagacagagtcttgctctgtcgcccaggctggagtacagtggcgtgatcttggctcactgcaacctctgcctcccaggttcaagtgagtctcctgcctcagcctcccgagtagttgggaatacaggcgtgcaccaccatacttggctaatttttgtatttttcgtagagacagggtttcaccatgttggccaggctggtctcgaactcctgacctcaggtgat

SEQ ID NO: 78193 - DNA, 601 bp, Human
tcaaatgataataataaattcatatttgctttggctttattttagaggtctaaaacttgctgattcattgagtcttctgtccagttattgaaggaaattgacccatcagatattcattcattccataactatctgagcctaccatgtgatagacagctgggctggtccctgggatatagcacagagcagctgaagatatggcaggcttttttggagttcacagtttaatgggggaagaaatacactattgaaatgatatgcaaataaatgtaaaattacattagcatgcactgaaggaaamgtatacagtactatgagaatgtatttaaatatcctggcctaggggctgctggggaaaactttcttgagaaagtgtttgaactaagagctgagagttgagttaaatagaagcttggggttgtgtgtgagtacttaggttaattagtttattgtttcacttaattatgtatcattattagattttgctgtatccattttccacattgtagttcctattttcatacttaatttggcccatttgttgaaacctcagtacatttgaggcactttaaactgattggttaaaagtcattacttaata

SEQ ID NO: 78194 - DNA, 601 bp, Human
ggtctaaaacttgctgattcattgagtcttctgtccagttattgaaggaaattgacccatcagatattcattcattccataactatctgagcctaccatgtgatagacagctgggctggtccctgggatatagcacagagcagctgaagatatggcaggcttttttggagttcacagtttaatgggggaagaaatacactattgaaatgatatgcaaataaatgtaaaattacattagcatgcactgaaggaaacgtatacagtactatgagaatgtatttaaatatcctggcctaggggmtgctggggaaaactttcttgagaaagtgtttgaactaagagctgagagttgagttaaatagaagcttggggttgtgtgtgagtacttaggttaattagtttattgtttcacttaattatgtatcattattagattttgctgtatccattttccacattgtagttcctattttcatacttaatttggcccatttgttgaaacctcagtacatttgaggcactttaaactgattggttaaaagtcattacttaatagctgaagaactggcagtagtttgacttccacatctcttccacaggt

SEQ ID NO: 78195 - DNA, 601 bp, Human; identical to SEQ ID NO: 38861

SEQ ID NO: 78196 - DNA, 601 bp, Human; identical to SEQ ID NO: 27827

SEQ ID NO: 78197 - DNA, 601 bp, Human
aagcagggtgccaccaatgagcgagagggacgaggagatgaagcccaggtacagggcctggccaatctcaaacttcatgccgctgggcagcagcgggttgtagaagttctgcaccacgtcgttggtggtccaggagacggccaccatgcacaggaggccggccaggatgaagagggtgccgccgaggatggcaaaggtggtcttggcgggtgtgcccttggcgcagcgcgtgcacttcatcccgatgacggcgcaggcgcaggctatgcccgagagcaggcaggagatgaccatgagggcrcgggcagcctggaggtcttggggcagcgccagcagggatcggtagatctggcactggtagatgcctgtgctgtgccacacacactccatccagagccctttcaggtaggacacggccgtgaggatgttggtgcccacgtgcgctgtcctccgccagtgcggcaggatggtggtgatcaacgtgcccaccatgcccaggaagctgagcaggaagcccagaagctgcacggccgtgctggccatggtgcggctgcctgcctaggccagccgggcagctccctgggccctcggggtcacgccg

SEQ ID NO: 78198 - DNA, 601 bp, Human
ttgagtatttcttaagatacagtttattcccagagagtttgctttaacatgcattttttaaatcatttgttctagagttctgtatcccatatatgcacttttggtttgtagcagtaactgttcagtaaaaattaaggactatgttacaaaccatatatgtcttatgcttacactagtatgcaagaagtgagtaggtgcttttaaaatcagaattctttggtcagttattggtgtgtggtggtgtttttactgactttttcagagaggtgtagcaggtacagttctaatcgtgcatatttcraaactaagtgttcttcatcaaagatgagtttttgtttttgtatcaattcaaatttctggtttcaataatagaaagaagagttgtctgcaggctcatagtcatcttttatttcagtgggcatttaaatcagccatatttggattgcagaatttcttaaaaagtcatcataaaatgcctttgacatgctcttttaaaattttgcttgtctttttattttcatatttaaacagtagtgacattacattattgaaaatgttttgaacatcttggaaattttatgttcaatattctcactgctgt

SEQ ID NO: 78199 - DNA, 601 bp, Human
aacccagggaaatgtcatgtaatttttattttccattatgacaggtgtctaatgcatgtcagcacaaaagtgtcatcactgctgtgtcatccctcttggttttcactatgcatctataattttttaagtttgcaggttttgtgggggtttttgtttgtttgtttttaaactggaaaaactagccattttgagagaaggaaggttctaggctatgagcatgaaggtccttgtgcctcttgggaaaatacctgaaatcctataatgaagacttttgatgcttcttgctttcaaaaagctgtgsttggtttggagtagacacctgttcagaaactaatgcaagtgtggagtctacatacgtgggctcatagtataatttgtggccagctacatttttccagtttaaataaactcactaaccattaatttttgaatatcttttgttgagatagttggacaaatgattttgctcttttggagagtgaagtccatgacatctaattttactgtcatccaaaatgtgtgttttatttcttttcttttactttctttttttttgtttgttttttgttttttgttagtgtgacagcgtacagaagagtac

SEQ ID NO: 78200 - DNA, 601 bp, Human
tggtttggagtagacacctgttcagaaactaatgcaagtgtggagtctacatacgtgggctcatagtataatttgtggccagctacatttttccagtttaaataaactcactaaccattaatttttgaatatcttttgttgagatagttggacaaatgattttgctcttttggagagtgaagtccatgacatctaattttactgtcatccaaaatgtgtgttttatttcttttcttttactttctttttttttgtttgttttttgttttttgttagtgtgacagcgtacagaagagtactrtgtttttgctccatgtttgtttgaatctttacctgacattgccgcttttgttaggtctgggcaatttgtgcttcagtgtttttgaaacaatggcttgataccatttctaaatgtatgtattataaaaaactaattatgtttagttggtcattacctacagagtgccatagtccacatgaacctcatatttgtactgcccattcttttgtgcaggttcataatatccataaagtatctagttaaaccttaagaattcaaatgaaagcaaaagtctaaaaccggttctacttctcattagcc

SEQ ID NO: 78201 - DNA, 601 bp, Human
tatttgtactgcccattcttttgtgcaggttcataatatccataaagtatctagttaaaccttaagaattcaaatgaaagcaaaagtctaaaaccggttctacttctcattagccaggatttaataatcccaacgttgaatgttctttgtaacaaccaatttttttctatctttcttctttaattattttaatgtagttgatttttctggaactcagttaaaatgaatggaaagaaaacttcaggatatcatttaatgactattaagtattattggtaaaaacgtgaagataagacttttrgatcacagcttcaaattttatggaaaattaagcaagcaatacctagccaatagttctgcttaactttttggttaagtattttgttgggattcctataaataatttttcacacaaagttttaaatttctggtgtactttgactctcaactgagagtggatagagtttttcttttgaggattacatcttaaaatgtccatcgcctggctggttataagcatttgtcaccttttgaaggtaaaatatactctggcccttcttgactcagttacaggtcattttaggtccagtaataagagtca

SEQ ID NO: 78202 - DNA, 601 bp, Human
aggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatrgagtagtctatgttgctccatataaattacagaatgaaaatagatggggcaaaagtttgactaaactttacctttttatagtttcactttttaagttatatttagaatatattgatagattataaattgattgtgaaacttttttctgaattttttcaacatgttttactcagttacatgagttaaaggatattttcagtcctgttatcttcaattgcagtctttaaaaaaacccaccctattgttctacttgttatatgtctattcatacagtaaattcatttcaaggtttatgccagt

SEQ ID NO: 78203 - DNA, 601 bp, Human
ataattacagacacctgtcctagttcttcaacacggagccctctgttaatctgctacaaacctctctgctgcttgctgttttcagtgagtcaactgaggcaatgtgtttccacagtgcaggagacacacctaccaaggcagcaggagcagttaccaacgatggcttggcccctttctacctgcgcacccttggatgtgacttcacctgtgattcagttgccacatctataaatgaagctacacatggtattgctgtaaggaatgaacacagcaaagcatctgaagcctatggtcagcagtmagctgacaaacgtcagccacaaagcaaacaggatgctccctgcactgcactggagtcactgacatactggtttgttttccccaccagactctaagctgcttaaggataggggcttgtggtgctcacttttggattaacatttcaacagcttatagagttgaggttgcagaaagcacccgacaagctcgttaaataaacaaatgctgtgtgactacaggagcagtaagtgatctgctgagccaagatcaactcaacatttctataaaagcggttcaatgatagccaagaaagtctagtaca

SEQ ID NO: 78204 - DNA, 601 bp, Human
tttgttttctcatgtgtaaaattataaggattatgtaactgggacacagagaaagagatcactgtggtctggaatagttattctttatagacacgaacttggaatttggacaggtgggaaggaatggcattcccccaagagaagtaaaatgccaaagatgaaggcaggaatgaatgtctgtaggggggagtggggtgccggcccgtggggttggatgctgggacacaagggtcactgtgtcccagggctcttgagaaccctgcaattgtttcacctcagtctagtatgaaagaaatatacmttttaggttcaactgagaaacaagaaacacagtttgcatcaaacattcagataaaaaatgttgttttcaatttattatacttcatcaggttctaattttggagttctgaaaaatggaccccccaaattaactttacttcactatagcttaataaataaataggtaaaaaacatactatgaaaaattttacttatgctcttggctgatggtttaaaaaaaagtagaatatgagagtatgagaaattgtccagatattcctagaaacccttgaggatccaattacaaatactgaaggctaaa

SEQ ID NO: 78205 - DNA, 601 bp, Human
atgggacgtggctctgcatgtttgttttctcatgtgtaaaattataaggattatgtaactgggacacagagaaagagatcactgtggtctggaatagttattctttatagacacgaacttggaatttggacaggtgggaaggaatggcattcccccaagagaagtaaaatgccaaagatgaaggcaggaatgaatgtctgtaggggggagtggggtgccggcccgtggggttggatgctgggacacaagggtcactgtgtcccagggctcttgagaaccctgcaattgtttcacctcagtstagtatgaaagaaatataccttttaggttcaactgagaaacaagaaacacagtttgcatcaaacattcagataaaaaatgttgttttcaatttattatacttcatcaggttctaattttggagttctgaaaaatggaccccccaaattaactttacttcactatagcttaataaataaataggtaaaaaacatactatgaaaaattttacttatgctcttggctgatggtttaaaaaaaagtagaatatgagagtatgagaaattgtccagatattcctagaaacccttgaggatccaat

SEQ ID NO: 78206 - DNA, 601 bp, Human
ctctcttaaatttgtggggttctccgaggtgactgtcgatacaggggtacagtaggccaacaacagctgttttaaaaaagttgacaatgttagaatacagcagattcaagttccagaatttcaacgtggtcattagtaacacagtacattactcaaaccagtccttttcctagaaaaaattatcagctataacttcagagtgattttatattcttgttctctttgagtaccactcccacaaaattgtactgtttgggaaaagttttttaaaaatcactattatttagtgtagttgaacatrtctcagtaaacacaggaaggaatcaagcagggattattcatattaatatgagcaatatgtaaccttatatttaatatccacatttgcctaaagcacacagaacttaaatgactatgtagttcaccttgtcttttcatccggtgtgatttctatcttacaataaaaaggttagcatctgtccaccccctgtcacatcacagctcttgacactcctccccaccacccagtactgggcctggggcacgtgatgagatacatatttgctgatgtgactttgacagtctgggtcacatgctccta

SEQ ID NO: 78207 - DNA, 601 bp, Human
ttaatgccaacaaaaactgctatgcagcgcatgacactggcccattctctcttaaatttgtggggttctccgaggtgactgtcgatacaggggtacagtaggccaacaacagctgttttaaaaaagttgacaatgttagaatacagcagattcaagttccagaatttcaacgtggtcattagtaacacagtacattactcaaaccagtccttttcctagaaaaaattatcagctataacttcagagtgattttatattcttgttctctttgagtaccactcccacaaaattgtactgtttrggaaaagttttttaaaaatcactattatttagtgtagttgaacatgtctcagtaaacacaggaaggaatcaagcagggattattcatattaatatgagcaatatgtaaccttatatttaatatccacatttgcctaaagcacacagaacttaaatgactatgtagttcaccttgtcttttcatccggtgtgatttctatcttacaataaaaaggttagcatctgtccaccccctgtcacatcacagctcttgacactcctccccaccacccagtactgggcctggggcacgtgatgagat

SEQ ID NO: 78208 - DNA, 601 bp, Human
tggtgaaggaggaggggacactcacacaccagtcactttctctactgcttactacagaaatttcaagaattcagaacactgaccacatctgcaattcaaaggggcagtgcgagggctctagttccttttctagatcaaatattatgaatttttataatttagcaaagaattacctgggtatcattacctatttttttaaatataagcttttctcagtagttgtcactcaagtctgaaccagaatatatgaacgcaaatttgaatgtatcatgtaaagtcattctatcaaggtaaagagacrcaagttttagaagataatatgatcatttcacttaccatagctaactgtcgtcctatgttccccaccgtgacgcctcctgagaaaaatatacaagggagccaagaacgaatatagaggaaatctggggatgtatacctggagcgagaaaagaaactgtaccttagcagtcaatttcacctggctcaattctacatcacagattctctgtagtggggatatgcagaacgcatatcaaccatccaatgttacgaatgttcatatttgtttggttgtaactgctactacttggttttcctttgc

SEQ ID NO: 78209 - DNA, 601 bp, Human
atggtgaaggaggaggggacactcacacaccagtcactttctctactgcttactacagaaatttcaagaattcagaacactgaccacatctgcaattcaaaggggcagtgcgagggctctagttccttttctagatcaaatattatgaatttttataatttagcaaagaattacctgggtatcattacctatttttttaaatataagcttttctcagtagttgtcactcaagtctgaaccagaatatatgaacgcaaatttgaatgtatcatgtaaagtcattctatcaaggtaaagagamacaagttttagaagataatatgatcatttcacttaccatagctaactgtcgtcctatgttccccaccgtgacgcctcctgagaaaaatatacaagggagccaagaacgaatatagaggaaatctggggatgtatacctggagcgagaaaagaaactgtaccttagcagtcaatttcacctggctcaattctacatcacagattctctgtagtggggatatgcagaacgcatatcaaccatccaatgttacgaatgttcatatttgtttggttgtaactgctactacttggttttcctttg

SEQ ID NO: 78210 - DNA, 601 bp, Human
ccacctctatgtttttaaattgaagtgctaagatgtcaatttttaactaatgagaactgctaaagccatcctggagttcactacctttccgtctccctcaggggggctgtgagagaagctctgcggggtagcactgctttctcctgcagctgagaacagatgcaatgttcaggcaggacagtccgtctacatggtgacccggccacgtgcagcggtgctctcatcaccacttctccatgcccagggccacctgccccacagaaaggtgctgcctgcctgaaccaggctgtccccttgcccrcccacattagtccctgccctggcccgagacagactctgcagcctcaggctcgatttgcttgactgtggactaagaggccagcatcatctgcatccactctgattttgtgaaaagaaacactggtggactgatgctcagggagcaaagtatcactgcatgaggtcatccagatctgcttccgatggtgaaggaggaggggacactcacacaccagtcactttctctactgcttactacagaaatttcaagaattcagaacactgaccacatctgcaattcaaaggggcagtgcgagggctc

SEQ ID NO: 78211 - DNA, 601 bp, Human
gatggcaccactgcactccagagctctgtctcaaaaaaaaaaaaaaaaaaggcaagcaaagtcctttcttctccatcatgagaaatttggcagcagagagtcagtaaccagtggaagactgcaaattctacctgtaattacttctggttttgtgaaacagccaagtggtcttcaaattcaactcctcacagaagggtatcagctggcaaaaataaatgtactgttttaaaaatagcatgaggtactaagataagttttcccagagcttatctccgagagcaacagctctaggtttttgttkttttttttaatttactttctttcagcctgccaaagtcaactcaaaataacatttaaaagtccacctctatgtttttaaattgaagtgctaagatgtcaatttttaactaatgagaactgctaaagccatcctggagttcactacctttccgtctccctcaggggggctgtgagagaagctctgcggggtagcactgctttctcctgcagctgagaacagatgcaatgttcaggcaggacagtccgtctacatggtgacccggccacgtgcagcggtgctctcatcaccacttctccatgc

SEQ ID NO: 78212 - DNA, 601 bp, Human
cagatttttaatattaaaaaaagcaaggccaggctcacgcctataatcccagtgctttgggaggccaaggtgggaggatggcttgagcccacgagttcgagcccggcctggacaaggcagggagataacatctccacaaaaagcaaaaaagttagccgggtatggtggcatgtgcctgtaatcccagctactcgggacgctgaagcgggaggattgcttgagtccgggagctcaaggttacagtgagctatgatggcaccactgcactccagagctctgtctcaaaaaaaaaaaaaaaaaaggcaagcaaagtcctttcttctccatcatgagaaatttggcagcagagagtcagtaaccagtggaagactgcaaattctacctgtaattacttctggttttgtgaaacagccaagtggtcttcaaattcaactcctcacagaagggtatcagctggcaaaaataaatgtactgttttaaaaatagcatgaggtactaagataagttttcccagagcttatctccgagagcaacagctctaggtttttgtttttttttttaatttactttctttcagcctgccaaagtcaactcaaaataa

SEQ ID NO: 78213 - DNA, 601 bp, Human
gttgaggacaattttattctaaaaaccttcttaggaattctctcccaaagagtaccgaaacaaaaatctcaaagcaagaaagcaatgatggagttgccagctctcctttgaagactattaacggggatgatggcgaatgcatgaaaacaacatactatttccatgtgggaccatccgaccagatttttaatattaaaaaaagcaaggccaggctcacgcctataatcccagtgctttgggaggccaaggtgggaggatggcttgagcccacgagttcgagcccggcctggacaaggcaggkagataacatctccacaaaaagcaaaaaagttagccgggtatggtggcatgtgcctgtaatcccagctactcgggacgctgaagcgggaggattgcttgagtccgggagctcaaggttacagtgagctatgatggcaccactgcactccagagctctgtctcaaaaaaaaaaaaaaaaaaggcaagcaaagtcctttcttctccatcatgagaaatttggcagcagagagtcagtaaccagtggaagactgcaaattctacctgtaattacttctggttttgtgaaacagccaagtggtct

SEQ ID NO: 78214 - DNA, 601 bp, Human
ggattacttaatgaaactatcttcaaaacgaaaatgtttcctccaaccatttctagatgtttagaacttatgaatgttgtgaaatttctacctccaccaaaataatgcttatttcttaaaaccgatttaaaaagccttgacatataacagcaccaacctatcaaacagaaataaccaactctttaaatgttattcaagttgtagttataatgtgtaattagtcaatctggttgaggacaattttattctaaaaaccttcttaggaattctctcccaaagagtaccgaaacaaaaatctcamagcaagaaagcaatgatggagttgccagctctcctttgaagactattaacggggatgatggcgaatgcatgaaaacaacatactatttccatgtgggaccatccgaccagatttttaatattaaaaaaagcaaggccaggctcacgcctataatcccagtgctttgggaggccaaggtgggaggatggcttgagcccacgagttcgagcccggcctggacaaggcagggagataacatctccacaaaaagcaaaaaagttagccgggtatggtggcatgtgcctgtaatcccagctactc

SEQ ID NO: 78215 - DNA, 601 bp, Human
gggacacacacaataagaccttctaggaaacatacatgcttttaggaattgatcatgtgaaagcactgccaatttttagatatgaacactgggagggttctatacaaactgcggtgagaaaacaaaagagcaaactcttggcagcaacctggaaagaaaactggtcatcacatttgactccctgttcactaatgtgctgataaataaatgggaagtggacttttagaatccctggtcgacagaggccacagtgaggcctggcaaagacgccagagacgaacgacagccagcccgggcggamctgacacgtggcacagggacttccagcagtgttgcctaatggtggcacattgtaaatggcaacccagacaccaacacaggctgctgtaaacctgcttccagggtgaaggcaggtgcgagctatgtgttgaaagggcagtgtggtatgctaatgagaagcacggtgccacgtcgacctctgccacccacttggccaagttgtttaatcttcctaagctgcaatttccccttttaaaaatgggctaataatagtttctacttcaaagacttgtgttatgaggactaaactggctaacaatgg

SEQ ID NO: 78216 - DNA, 601 bp, Human
tagcactaaatgtataaatattttaattaccaattaagtaggtcctaacatgggaaagattgacactttctttgactgaagcaacaagattgagaggtgggacatgtgcagagaactggagaccgaggccagctctcccagctcccctgcaccgtcttcatggctctggccccgtgagccacagctctcacctgcaaaattaggataattctctgcctcaggtgaaattacgctgctgaggcccttatataaagcctgttatataagtgtaagatattggtgaaagtttaactaaattaayatctatataaaggaaacacccaattttatcaaagcatggtgatgcttagggtatgataggttcctgaaagttctaactgcaatttaagggattgaacctttatctgaagggaggtttctgccacaaacctttattagtatctgatgcctgtgttataacccaccttaccagcagtttgttgaaacagacattggaaataggtcatgctttgtaatactgaagctctgtgtgccctcaattcacacagagcttcacagttgggaaatcctttctacatgttcttcctcatctgaccctcac

SEQ ID NO: 78217 - DNA, 601 bp, Human
cattcttagatgactatggatttcgaaataaacttcataaactgaggtgaaaattccaatatatcgcagtgtgggaaccaagacttttcattgccttttgctcagtaagattgtctacacaaactgccacgggaggaatgacaagcagttgacccactggtgatacacacacgtgtgaccatgtaaacacgccactgcaggacggacgagcgtgaccgtgaagcgtggccacgccgcgaccccacttagagtgtgacctctctataatcactgctgcttttcttgttttgtttttttttttaaacacagccctatttttaaaaatcttttggataaatattattcctattacaccatacttcatgtttgttaagcaccatcaacctacctcctttgggcactgacacaaaactgcgggttggtaattgagtcttagttcaaggctttgaaatatggcaacttgttttaatcacatgaatgaaatcgaatacttgggaagctgccacctgcctgaacccacgtagcctgggcagaatgctccagggcacagacaggcgccagtgcgggcagtcaagggaagacttcagggtaagtcatcatt

SEQ ID NO: 78218 - DNA, 601 bp, Human; identical to SEQ ID NO: 36840

SEQ ID NO: 78219 - DNA, 601 bp, Human; identical to SEQ ID NO: 36841

SEQ ID NO: 78220 - DNA, 601 bp, Human; identical to SEQ ID NO: 36842

SEQ ID NO: 78221 - DNA, 601 bp, Human; identical to SEQ ID NO: 36843

SEQ ID NO: 78222 - DNA, 601 bp, Human; identical to SEQ ID NO: 36844

SEQ ID NO: 78223 - DNA, 601 bp, Human; identical to SEQ ID NO: 36845

SEQ ID NO: 78224 - DNA, 601 bp, Human; identical to SEQ ID NO: 36846

SEQ ID NO: 78225 - DNA, 601 bp, Human; identical to SEQ ID NO: 36847

SEQ ID NO: 78226 - DNA, 601 bp, Human; identical to SEQ ID NO: 36848

SEQ ID NO: 78227 - DNA, 601 bp, Human; identical to SEQ ID NO: 36849

SEQ ID NO: 78228 - DNA, 601 bp, Human; identical to SEQ ID NO: 36850

SEQ ID NO: 78229 - DNA, 601 bp, Human
ttttctctgcaaagttaactggcttacaaagggctataacccatgtgctctgccttactggcatttccctctaatctgagctaagaaggtcagctaaacagactatatttggactaagctgctccctgtagcccaactactaaatatcatcatcagccaaagccacgtcatcaggcaggtggattcggatttttcacctcaaatgataagacgtgctttctggctcctccagcccctagcaatagtgacacacagtccctccctggacagtcttcctttatttctcacagagtcctgttamcctcccaagcgactgcctctgcagactctccttacgggtttggccttcctctctggacaaaggggcgtccctcggataactgttgcctggcaacatctctactgtgcccttggagaaacagagacactgtctgcttgaaagctaaggcatgctgttggcttttgggctgcctatagtgaaatacaaagattaggtttcttaattaatagttttctcactttaaaaggttatttaggattcagttctttctaaacatcattttttttcctctaccctccactttcaagccctgcccttgct

SEQ ID NO: 78230 - DNA, 601 bp, Human
ctgctggcatttatccttattagacttcattttgtcagtttcagtccattgtctcttcctgtccgcatgtctcattctgccaccgtacattagcaccgtacattagccagctagcgcatccaacttagccatctgcaaatctgataataagccttttatattttcaactgcaatctcaccctaatctgatgccaacatgctattcaagattctttaggttcagctgttcacccagccctcaagttactcaactgtgctttctcatggagcccactctgactcctctgagtgagaaattctytttttcccccctggaaattttgaaggctccaaggaaaaagttaaattatatttaataacttctgtttcaaagaccaaggaaattataaaacccattagaaagactgtaatcaaaaattagtcaacatgaagtttgggcagttggcagtgtaaattttatttatctagaacatcccctcttgaggagttgtataaatcctccacaatgccagaaaacgaggcatcacttcatagggcattctgtatttttccacatggtttatactttctctctactaaaatagaaacttctccgggtcag

SEQ ID NO: 78231 - DNA, 601 bp, Human
ttatccagaatttgatgtactggacacatcatttattaatttttaaaattaaaaaaaatttttttagatggagcctagctctgtcatccaggctggagtgcagtggcatgatcttggctcactgtaacctctgcctcctgggttcaagagattctcttgcctcatcctcctgagtagctgggactacaggcatgcaccaccataccctgctaattttttattctattttatttttagtagagatgggtttcaccatgctggccaggctggtctcaaacccctgacctcaggtgatccgccygccttggcctcccaaagtgctgggattacaggcgtgagccacagtgcccagcccataatttattaattcaacggaggattttggtcacattgcctggggggttaagagctcaagttctggaatcatacaatcttggattcaagtcccagctccaccacttagtagctgcataaccgcgggtaagtaagttacttaacctctctgaacttcagtttccttctctttaaaatgaagataaaaataatagcaccttcacggaggattaagttatatagtgtgtgtaaatgacctcccacagtg

SEQ ID NO: 78232 - DNA, 601 bp, Human
tcctgagtttaagcaattctcctgcctcagcctcccaagtagctggagctacaggtgcttagaaaaactaaggaaacctccttagtgaaaccactacacctggctaatgtttttggattttttttttttttttttttttttttttttttttttagtaggtacgagctttaaccagcttgttggccaggctggtcttaaactcctgacctcaagtgatctgctcatctcagtctcccaaagtgctgggattacaggcatgaaccattgcacccagcccactggtacacattttttatcttcrtttataatcgcagtcctgacactggccttaaatgcccagggcagggccagtctgaactccaggcccagcttcagtgggatattggctctgtgctgggtgtttggtgggctcagctctattctcatgtctttcctgctcccttgtaagtgatactatgtgctcgggagacacggcctggggctcaggatatagtttgtgattacagaggtaacatcactgagtggggaagagggaggactctggagtcagccgggactccactgtgtgaccctagacaaggtattcagcctctctgggctt

SEQ ID NO: 78233 - DNA, 601 bp, Human
actgtgttagccaggatggtctcaatctcctgacctcgtgatcctcctacctcggcctcccaaattgcggggatcagaagcatgagccagcgcacccggccttaattttaaaaatttaaataattcccaataattctcaagttccaatgaattccaaaaatgaaaatagtacaaggaatacctatacactctttttttttttccctgaaccatttgagggtaagttacacacattttggctggtcctttacccctaaatacttcagtgtatattttcctttctttcttttttttttttttwaaaatttgagacagggtctcactctgtcacccaggctggagtgcagtggcatgatcacagctcactgcagcctcaacctcccaggctcagggtatattttctacgagtagggattttctcttccttagtggccacagtaccagttataaactcctttctactttttaatttaatgatggggaagttgagacatagggcagttaaaaagatgtttcgcatgtttgaggttcatggaccaaatctttgttgattctctcacttggaacattctctctttccatctctgcctgtacattccaa

SEQ ID NO: 78234 - DNA, 601 bp, Human
cactgtgttagccaggatggtctcaatctcctgacctcgtgatcctcctacctcggcctcccaaattgcggggatcagaagcatgagccagcgcacccggccttaattttaaaaatttaaataattcccaataattctcaagttccaatgaattccaaaaatgaaaatagtacaaggaatacctatacactctttttttttttccctgaaccatttgagggtaagttacacacattttggctggtcctttacccctaaatacttcagtgtatattttcctttctttctttttttttttttwtaaaatttgagacagggtctcactctgtcacccaggctggagtgcagtggcatgatcacagctcactgcagcctcaacctcccaggctcagggtatattttctacgagtagggattttctcttccttagtggccacagtaccagttataaactcctttctactttttaatttaatgatggggaagttgagacatagggcagttaaaaagatgtttcgcatgtttgaggttcatggaccaaatctttgttgattctctcacttggaacattctctctttccatctctgcctgtacattcca

SEQ ID NO: 78235 - DNA, 601 bp, Human
tcactgtgttagccaggatggtctcaatctcctgacctcgtgatcctcctacctcggcctcccaaattgcggggatcagaagcatgagccagcgcacccggccttaattttaaaaatttaaataattcccaataattctcaagttccaatgaattccaaaaatgaaaatagtacaaggaatacctatacactctttttttttttccctgaaccatttgagggtaagttacacacattttggctggtcctttacccctaaatacttcagtgtatattttcctttctttcttttttttttttwttaaaatttgagacagggtctcactctgtcacccaggctggagtgcagtggcatgatcacagctcactgcagcctcaacctcccaggctcagggtatattttctacgagtagggattttctcttccttagtggccacagtaccagttataaactcctttctactttttaatttaatgatggggaagttgagacatagggcagttaaaaagatgtttcgcatgtttgaggttcatggaccaaatctttgttgattctctcacttggaacattctctctttccatctctgcctgtacattcc

SEQ ID NO: 78236 - DNA, 601 bp, Human
ttcactgtgttagccaggatggtctcaatctcctgacctcgtgatcctcctacctcggcctcccaaattgcggggatcagaagcatgagccagcgcacccggccttaattttaaaaatttaaataattcccaataattctcaagttccaatgaattccaaaaatgaaaatagtacaaggaatacctatacactctttttttttttccctgaaccatttgagggtaagttacacacattttggctggtcctttacccctaaatacttcagtgtatattttcctttctttctttttttttttwtttaaaatttgagacagggtctcactctgtcacccaggctggagtgcagtggcatgatcacagctcactgcagcctcaacctcccaggctcagggtatattttctacgagtagggattttctcttccttagtggccacagtaccagttataaactcctttctactttttaatttaatgatggggaagttgagacatagggcagttaaaaagatgtttcgcatgtttgaggttcatggaccaaatctttgttgattctctcacttggaacattctctctttccatctctgcctgtacattc

SEQ ID NO: 78237 - DNA, 601 bp, Human
tttcactgtgttagccaggatggtctcaatctcctgacctcgtgatcctcctacctcggcctcccaaattgcggggatcagaagcatgagccagcgcacccggccttaattttaaaaatttaaataattcccaataattctcaagttccaatgaattccaaaaatgaaaatagtacaaggaatacctatacactctttttttttttccctgaaccatttgagggtaagttacacacattttggctggtcctttacccctaaatacttcagtgtatattttcctttctttcttttttttttwttttaaaatttgagacagggtctcactctgtcacccaggctggagtgcagtggcatgatcacagctcactgcagcctcaacctcccaggctcagggtatattttctacgagtagggattttctcttccttagtggccacagtaccagttataaactcctttctactttttaatttaatgatggggaagttgagacatagggcagttaaaaagatgtttcgcatgtttgaggttcatggaccaaatctttgttgattctctcacttggaacattctctctttccatctctgcctgtacatt

SEQ ID NO: 78238 - DNA, 601 bp, Human
ccatcctagagtcacatctactgagcgttcattgtgggcaggcactgtgctaagtacttgacagattatttcattcaatctggcccgtaactctataggatagatgttcttctccactttggaaaacataaaaccactgtatttaaatatgatgtgaatatgattttaaagaataaacacatataattttatattgatcttttaaaataaccctaggtttctccccaaacctaatttttaatgtttttagaaaatattagaaaattattttcatttcatttctattagaaaattaatacayactcagtatggaaaacttcaaaatataaaaaaagttaaagacaaaattacccttaatcatgctactgtaaatacttatagtttcttccatttttcctatacctatatagataaatgcatttatacagtatgtatacttttatatcttgcctttttttcatttaacatcatatcctcattattgtttttctttgagacagagtcttgctcaatttttttttttttttttttttttttttgtggagatggagtctcgctctgtcgcccaggctggagtgcagtggtgcgatctcggctcact

SEQ ID NO: 78239 - DNA, 601 bp, Human
gccacgcagatgacccccaccagcagcagcgtggtgttcttgaagtactccgccgccacctgtagggaggccaggcatgtcagtcaccctcccggaccaaagacccagggcccagcaccagctgggagaatgggccatacccaataaaacctgttctcaatcaaagaggctggcgaaggggaggcaggggggtgaggattattgaaatagccgcccatcctagagtcacatctactgagcgttcattgtgggcaggcactgtgctaagtacttgacagattatttcattcaatctggcccrtaactctataggatagatgttcttctccactttggaaaacataaaaccactgtatttaaatatgatgtgaatatgattttaaagaataaacacatataattttatattgatcttttaaaataaccctaggtttctccccaaacctaatttttaatgtttttagaaaatattagaaaattattttcatttcatttctattagaaaattaatacatactcagtatggaaaacttcaaaatataaaaaaagttaaagacaaaattacccttaatcatgctactgtaaatacttatagtttctt

SEQ ID NO: 78240 - DNA, 601 bp, Human; identical to SEQ ID NO: 36851

SEQ ID NO: 78241 - DNA, 601 bp, Human; identical to SEQ ID NO: 36852

SEQ ID NO: 78242 - DNA, 601 bp, Human; identical to SEQ ID NO: 36853

SEQ ID NO: 78243 - DNA, 601 bp, Human; identical to SEQ ID NO: 36854

SEQ ID NO: 78244 - DNA, 601 bp, Human; identical to SEQ ID NO: 36855

SEQ ID NO: 78245 - DNA, 601 bp, Human; identical to SEQ ID NO: 36856

SEQ ID NO: 78246 - DNA, 601 bp, Human; identical to SEQ ID NO: 36857

SEQ ID NO: 78247 - DNA, 601 bp, Human; identical to SEQ ID NO: 36858

SEQ ID NO: 78248 - DNA, 601 bp, Human; identical to SEQ ID NO: 36859

SEQ ID NO: 78249 - DNA, 601 bp, Human; identical to SEQ ID NO: 36860

SEQ ID NO: 78250 - DNA, 601 bp, Human; identical to SEQ ID NO: 36861

SEQ ID NO: 78251 - DNA, 601 bp, Human; identical to SEQ ID NO: 36862

SEQ ID NO: 78252 - DNA, 601 bp, Human; identical to SEQ ID NO: 36863

SEQ ID NO: 78253 - DNA, 601 bp, Human; identical to SEQ ID NO: 36864

SEQ ID NO: 78254 - DNA, 601 bp, Human; identical to SEQ ID NO: 36865

SEQ ID NO: 78255 - DNA, 601 bp, Human; identical to SEQ ID NO: 36866

SEQ ID NO: 78256 - DNA, 601 bp, Human; identical to SEQ ID NO: 36867

SEQ ID NO: 78257 - DNA, 601 bp, Human; identical to SEQ ID NO: 36868

SEQ ID NO: 78258 - DNA, 601 bp, Human
tgaagcggagtcttgctctgttgcccaggctggagtgcagtgtcacgatcttggctcactgcaacctctgtctcctggggtcaagtgattctcctgcctcagcctcctaagtagcggggattacaggcgcctgccaccatggctggttaacttttgtatttttagtagagatggggtttcaccatgttggccaggctggtcttgaactcctgacctcaagtgatctgcccaccttggcctcccagagtgctgggattacaggtgtgagccaccgtgctgggacttttttttttttttttttgagatggagtcttgccctgttgcccaggctggagtgcagtggcatgatcttggctcactgcaacctctgcttcccaggttcaagtgattctcctacctcagcctcctgagtagctgggattacaggtgtgcaccaccacacccagctcatttttgtatttttagtagagacggagtttcaccatgttggtcaggctggtctagggatcctgacctcgtgatgcgcctgccttggcctcccaaagcgctgggattacaggcatgagccactgcgcccggccttttttttgtttttgttttt

SEQ ID NO: 78259 - DNA, 601 bp, Human
aaactataaatctgaccatctcactccctgcttaaaattctttaaaagcatgtcagagccttcagatgcagtccaagttcctcagtgggtcttgccaagccctgaagatctgcccatccagctccctggcctcctcttaccctctgtcgttttcttttatgtgctccgctgtcctgcctcggagccctcctacatactgctttctttgtctggctaatctctcttaatctagcttactcccgtccttcaggtttccacatggtcgcctcttcagggaggcatttcctccctgcaaatgggygagctctcccagcagggctctccctgcagagtcctggacttctccagtctcacttagctataatgacttgatttccccctttttttccttttttaaatttttatttatctatttattttttgagatggagtcttgctttgtcacccaggctggagtgctgtggtgcgatctcagctcactgcaacctctgcctcctaggctcaagcgattctcctgcctcagcctcctaagtagctgggattacaggcacctgctaccatgcctggttaacttttgtatgtttagtagagatggggtttc

SEQ ID NO: 78260 - DNA, 582 bp, Human
cccaagtagctgggattacatacaggagcacactaccatgcccagctaatttttgtatttttagtagagacggggtttcgccatgttggccaggctggttttgaactcctgacctcagatgatctgcctgccttcgcctcccaaaatgctgggattacgggcatgagccacagtgcccgtcccctactttccttttattatcaccccacatctctccttcccttcacagccagctctccattttctcacctctaccttagtcctcaactcaccagaatctgsctgcttctcccacctcttgaccaaggtcctcttgcctacatcaccagtaacctccacatcaccaaatctaatggatacgttttcatccttactttgcatcatcattcattgacattaaatattgtaggcacttcctttttcttgaaatactttcctcccttgggtagagtggcaccagatttcccttccctctctgctgtctgatattgtttccttctgtccgttaaatatgtgagcttaatatttatgtcctctgttctccttaccctgtatattctaggtaatttcctccactcccgt

SEQ ID NO: 78261 - DNA, 601 bp, Human; identical to SEQ ID NO: 36869

SEQ ID NO: 78262 - DNA, 601 bp, Human; identical to SEQ ID NO: 36870

SEQ ID NO: 78263 - DNA, 601 bp, Human; identical to SEQ ID NO: 36871

SEQ ID NO: 78264 - DNA, 601 bp, Human
agccgggtgcagtggctcatgcctgtcatcccagcattttgggaggccgaggcaggtggatcacttgaggtcaggagtttgagactagcctggccaacatggtgaaaccgcgtctctactaaaaatacaaaaactagctggcatcatggtgcacgcctgtaatcccagctacttgggaggctgaggcaagagaatcgcttgaacccaggaggcggaggttgcagtgagctgagattgtgccactgcactccagcctgggtgacagagcaagactgtctcaaaaaaaaaaaccccaaaaaaacagaattcaagaattaccttgctaccagaagccagagcatagcctcccccaaccagaatgacaatctcccagggcatggtcttctggaagtccttccacgtgatgatgggctcggtccccagtgagtgctcctggttctctcctggattagagagagatgtaaagccagataaaccctgatggacgtgatttgtggagacaggagcctaattggtgaagtggatgatttgggatactgctatttggggcgggggccgggaggggggtgggaatctgaaggaccttggtaaatctctttgg

SEQ ID NO: 78265 - DNA, 601 bp, Human
aacagaattcaagccgggtgcagtggctcatgcctgtcatcccagcattttgggaggccgaggcaggtggatcacttgaggtcaggagtttgagactagcctggccaacatggtgaaaccgcgtctctactaaaaatacaaaaactagctggcatcatggtgcacgcctgtaatcccagctacttgggaggctgaggcaagagaatcgcttgaacccaggaggcggaggttgcagtgagctgagattgtgccactgcactccagcctgggtgacagagcaagactgtctcaaaaaaaaaaaccccaaaaaaacagaattcaagaattaccttgctaccagaagccagagcatagcctcccccaaccagaatgacaatctcccagggcatggtcttctggaagtccttccacgtgatgatgggctcggtccccagtgagtgctcctggttctctcctggattagagagagatgtaaagccagataaaccctgatggacgtgatttgtggagacaggagcctaattggtgaagtggatgatttgggatactgctatttggggcgggggccgggaggggggtgggaatctgaaggaccttggta

SEQ ID NO: 78266 - DNA, 601 bp, Human
tagcagcatgggccccatagatgaactatcaatgcccatgtgtcatgactgtgtggcacagcccatctgttcctctgttcctagtagcgctgagaagcttagggcagcagaggacatccatcctgctctattgtttcccttcccagggactctgtgaacattctcagctgctttgagtctttcctcccatgcccataatgactcattaggtaaagatgctggaaaagtatttgacccataagaacagaattcaagccgggtgcagtggctcatgcctgtcatcccagcattttgggaggcygaggcaggtggatcacttgaggtcaggagtttgagactagcctggccaacatggtgaaaccgcgtctctactaaaaatacaaaaactagctggcatcatggtgcacgcctgtaatcccagctacttgggaggctgaggcaagagaatcgcttgaacccaggaggcggaggttgcagtgagctgagattgtgccactgcactccagcctgggtgacagagcaagactgtctcaaaaaaaaaaaccccaaaaaaacagaattcaagaattaccttgctaccagaagccagagcatagcctcc

SEQ ID NO: 78267 - DNA, 601 bp, Human
aaattagtagaggcagtaggctttacagaaataactgtactatctctaatatgtgcacaattttgtttttattgttttttttttgtttttgttcttgttttttgttttggtggcaggggatagggtctccctctgtctcccaggctggagtgcaatggtgggatcttggctcactgcagctttgaactcctgggctcaagcgatcctctcacttcaacctcctgagtagctgggactacaggtacgcaccaccacactgggctaacttttgtttttgtagagataggatcttactatgttkcccaggctagtctcaaactcctggactcaagcaatcctcccgccatggcctcccaaagtgctgggattacagacatgagccactgtgcccagcccaattttggttaaaaaaaaaaataaaatcttgccaggccaatcttgtcagaggccaaaactaacaactgaaattcaataaagataaatataaatatcccgaacttggaatgagaaatattgatggcatatatataggatggggtgaaggtccagtaatgatgaacagttaaaaagaatgaagggttctaattgactgcagttttaa

SEQ ID NO: 78268 - DNA, 601 bp, Human
ctcctcaacttcagtctcgttaccctttctctagcctctgacatccttaccctgtgcattgattcgacaatgcccttcacagagtgccaagtatagccatttaatctgcttttgaaaccagtttattttgttacctaaaaaagggaaaaatttatcaacatctgtggatagtagcctttcctgtgtttttaaggagatgaacaggcagggctgagcactggaggttttacaggagtaataaagtagagggggataaaagtctatttccacttagtggagaaggtgcctcttaagtgccatrgaggctggtcattcagccccaacctgttttaggttcaaatctcatcatggctgacattagttctactatctgtcaggaatttttttttaattaagaggagggtcttgctctattgcccagggtccaggatgagtgcagcagcatgatcacagctcactgcagtctcaacctcctgggttcaagcaatcctcccacctcagccttccaagtagctgggaccacaggcacataccatcacgccctgctctttttatttgtagagacagagtctttccatgttgcccaggcctgtctcaaaca

SEQ ID NO: 78269 - DNA, 601 bp, Human
gcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaatmacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcaga

SEQ ID NO: 78270 - DNA, 601 bp, Human
ctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaawctgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaa

SEQ ID NO: 78271 - DNA, 601 bp, Human
acattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatctkttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaa

SEQ ID NO: 78272 - DNA, 601 bp, Human
cattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttwtgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaa

SEQ ID NO: 78273 - DNA, 601 bp, Human
tgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatgsttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaa

SEQ ID NO: 78274 - DNA, 601 bp, Human
caacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtaytttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttct

SEQ ID NO: 78275 - DNA, 601 bp, Human
ccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgag

SEQ ID NO: 78276 - DNA, 601 bp, Human
agctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgc

SEQ ID NO: 78277 - DNA, 601 bp, Human
acattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagygaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatg

SEQ ID NO: 78278 - DNA, 601 bp, Human
tttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaaggrcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccat

SEQ ID NO: 78279 - DNA, 601 bp, Human
gactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctrctcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgag

SEQ ID NO: 78280 - DNA, 601 bp, Human
ctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagta

SEQ ID NO: 78281 - DNA, 601 bp, Human
ataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggg

SEQ ID NO: 78282 - DNA, 601 bp, Human
ctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaa

SEQ ID NO: 78283 - DNA, 601 bp, Human
tctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtktcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagg

SEQ ID NO: 78284 - DNA, 601 bp, Human
tttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttsttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaaggga

SEQ ID NO: 78285 - DNA, 601 bp, Human
caatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccatacmgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggat

SEQ ID NO: 78286 - DNA, 601 bp, Human
ggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatkttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagcttt

SEQ ID NO: 78287 - DNA, 601 bp, Human
cagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgt

SEQ ID NO: 78288 - DNA, 601 bp, Human
gtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattat

SEQ ID NO: 78289 - DNA, 601 bp, Human
agaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtg

SEQ ID NO: 78290 - DNA, 601 bp, Human
gggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcscggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagact

SEQ ID NO: 78291 - DNA, 601 bp, Human
gccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaa

SEQ ID NO: 78292 - DNA, 601 bp, Human
accatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacwtgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgt

SEQ ID NO: 78293 - DNA, 601 bp, Human
tatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgagg

SEQ ID NO: 78294 - DNA, 601 bp, Human
agcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgac

SEQ ID NO: 78295 - DNA, 601 bp, Human
ttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtgsagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaa

SEQ ID NO: 78296 - DNA, 601 bp, Human
ttgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcaytctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttg

SEQ ID NO: 78297 - DNA, 601 bp, Human
aaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgt

SEQ ID NO: 78298 - DNA, 601 bp, Human
gtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgctctaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagcgagtaaagggggaatatgttctagaagaagggcgctcacctcagtaaattgatgggt

SEQ ID NO: 78299 - DNA, 601 bp, Human
gataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactattt

SEQ ID NO: 78300 - DNA, 601 bp, Human
ttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccartctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcc

SEQ ID NO: 78301 - DNA, 601 bp, Human
aactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccagtctcagcctcctcagtrgctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggttt

SEQ ID NO: 78302 - DNA, 601 bp, Human
ttattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccagtctcagcctcctcagtggctgggattacaggcatgtgctactacmcccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttt

SEQ ID NO: 78303 - DNA, 601 bp, Human
tgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcagggg

SEQ ID NO: 78304 - DNA, 601 bp, Human
accactttaaacattgcatccttgagttgcatatgatgggatctcttgaatcatttacattttgaaaaaagaaagtgaaatattctttaagaagccaaagtaatccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatatttgccggatccaaaaaaaatactgtgtatsaactactgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataa

SEQ ID NO: 78305 - DNA, 601 bp, Human
agtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgcaatggttagcatatcaacttccttctgtttttagtgactctaatacattatattcacct

SEQ ID NO: 78306 - DNA, 601 bp, Human
acctttggtgtatagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggycatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgag

SEQ ID NO: 78307 - DNA, 601 bp, Human
atagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgsaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgagaaccatcctgt

SEQ ID NO: 78308 - DNA, 601 bp, Human
aatgtattgttggagcccttagttcaacactgtcttttttcaggtcatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggct

SEQ ID NO: 78309 - DNA, 601 bp, Human
atgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgc

SEQ ID NO: 78310 - DNA, 601 bp, Human
gatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggygtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaa

SEQ ID NO: 78311 - DNA, 601 bp, Human
ggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgatyccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaatcaaaattgatgcaaaaaa

SEQ ID NO: 78312 - DNA, 601 bp, Human
tagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagttygagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaatcaaaattgatgcaaaaaatatgataacatttcaaaatttaaatcaagacaaattcaatattatagcaa

SEQ ID NO: 78313 - DNA, 601 bp, Human
tgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtg

SEQ ID NO: 78314 - DNA, 601 bp, Human
tgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaa

SEQ ID NO: 78315 - DNA, 601 bp, Human
ggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggc

SEQ ID NO: 78316 - DNA, 601 bp, Human
tagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatc

SEQ ID NO: 78317 - DNA, 601 bp, Human
ttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcag

SEQ ID NO: 78318 - DNA, 601 bp, Human
gctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcagtgtaataacctgtcttcagtctactctwtgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaa

SEQ ID NO: 78319 - DNA, 601 bp, Human
tgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaatgaatactctatttcagttgagtttttagtttgctctgttacgtgaggacacatcacttgcacctcagtgtgagtttgaaagtgttttctctggagaataattctgaagaaataggccctccagatatcrgtagtgacaggggtatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtcca

SEQ ID NO: 78320 - DNA, 601 bp, Human
tgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgaga

SEQ ID NO: 78321 - DNA, 601 bp, Human
gcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtt

SEQ ID NO: 78322 - DNA, 601 bp, Human
ctccattcccatacttctgtgaagaaatacccgagactgggtaatttataaagaaaaagagatttactgaactcagtcgtttcacctggctggggaggcctcaaaattatggcagaaggcaaaggaggagcaaaggcacatcttacatggcagcagacaagaaagcgtgtgcaggggaactgccctttataaaatcaccagatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacag

SEQ ID NO: 78323 - DNA, 601 bp, Human
gttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataycttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaa

SEQ ID NO: 78324 - DNA, 601 bp, Human
ctgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtractcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagact

SEQ ID NO: 78325 - DNA, 601 bp, Human
aagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggc

SEQ ID NO: 78326 - DNA, 601 bp, Human
cagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcasactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtgg

SEQ ID NO: 78327 - DNA, 601 bp, Human
cacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagca

SEQ ID NO: 78328 - DNA, 601 bp, Human
gttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgat

SEQ ID NO: 78329 - DNA, 601 bp, Human
ccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccctcatcgtggttcccttttagattttcttgtttgcttttctttaaagctgct

SEQ ID NO: 78330 - DNA, 601 bp, Human
attgttcaaattttcattactaacacctctcacattgttagaaaacagttttatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttc

SEQ ID NO: 78331 - DNA, 601 bp, Human
gtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatrtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttt

SEQ ID NO: 78332 - DNA, 601 bp, Human
taagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatgtaaattaattaaaattaaaagttcaattgctctgaaatagcagccacatttcaaatcttcagtagccagatgtggttattggctaccwtattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtg

SEQ ID NO: 78333 - DNA, 601 bp, Human
tcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacc

SEQ ID NO: 78334 - DNA, 601 bp, Human
aggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatgcatgagtgtgttagactgcttttcttctattttttaaaaatgcacccaaatgtaaaagacacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaag

SEQ ID NO: 78335 - DNA, 601 bp, Human
tgttagactgcttttcttctattttttaaaaatgcacccaaatgtaaaagacacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgc

SEQ ID NO: 78336 - DNA, 601 bp, Human
agaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacatttgtgagctcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaactgttgtg

SEQ ID NO: 78337 - DNA, 601 bp, Human
tttgagcatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaaattttttttttttttttggttgtggtggcgttggc

SEQ ID NO: 78338 - DNA, 601 bp, Human
gataagcaaagggtgtatcactggtatgggtaactgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaawttttttttttttttttggttgtggtggcgttggcttttacttggggttgacctttccttatcaaggacatacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcg

SEQ ID NO: 78339 - DNA, 601 bp, Human
ggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtyagctcctacaccatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcag

SEQ ID NO: 78340 - DNA, 601 bp, Human
ctcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctsctacaccatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctcc

SEQ ID NO: 78341 - DNA, 601 bp, Human
agctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctcctacaccatgagtgcttttgtatsgtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctccgccttccaggttcaagtgatcctc

SEQ ID NO: 78342 - DNA, 601 bp, Human
accatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaa

SEQ ID NO: 78343 - DNA, 601 bp, Human
gatgtccttgtcgtgttgaccttattggagaatttcctatctgtgatgacctgtaaatggaatttaagggaggaatcacacgtgttagcacggggttggcattgcgtggctgttttcaattaacttgaccactatcataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccgggaacaccttttgctgtgccatgtgcatggaaggagaggaatgaatgactgttgaagccagatggccttgctcattgattctctcctttcccgccctctcaagccatccagaaggagaatgaaatgctcaaatcaagggagttaact

SEQ ID NO: 78344 - DNA, 601 bp, Human
actatcataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggagtccctttagacaacatcactgacaactcactatgtaaaaccaaacaaattattagctttcttactgtgtgtttgcatttgctgtgcccagggaaatgggaagtgcattgaggaagaggccccaagacawggagaagtcactccaactttccgggaacaccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggccaagatgttagtaatgggaaactttggaggaaggcaaagtcagaaattattctgcagggagatttggggatgttggatgctaaggcccaagccgtctattgtatgccttttgctttggcataaaa

SEQ ID NO: 78345 - DNA, 601 bp, Human
taccattctatgaccattgaatctccatggacatgttttgggaaatggatttgtcccattacactgctttctttagtgcataagatcttgaagggagggatgcattctatgcaccccaagtttctggtttactcgtggtttcaggagtccctttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccggraacaccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggccaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgt

SEQ ID NO: 78346 - DNA, 601 bp, Human
attctatgaccattgaatctccatggacatgttttgggaaatggatttgtcccattacactgctttctttagtgcataagatcttgaagggagggatgcattctatgcaccccaagtttctggtttactcgtggtttcaggagtccctttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccgggaacmccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggccaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatct

SEQ ID NO: 78347 - DNA, 601 bp, Human
tttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccgggaacaccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatctctgctcatgcttgagagtggtggtgtttggaaagactcaatagcatatgcacatgaggaagttgaccaaatgattccacagcgcatactcattttttgctctgattctagcttttcctccaattttattcagaatttgttcttttct

SEQ ID NO: 78348 - DNA, 601 bp, Human
aggaatacaggcaggagccactgttactggtctgtttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttca

SEQ ID NO: 78349 - DNA, 601 bp, Human
gtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctmagtggtcaggtgggactcatggagattttccgttctttggagactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgt

SEQ ID NO: 78350 - DNA, 601 bp, Human
gctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggagactagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctccc

SEQ ID NO: 78351 - DNA, 601 bp, Human
tttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattc

SEQ ID NO: 78352 - DNA, 601 bp, Human
gcaagcgatgtgtgtctggattaagagaacctgagaatctctatttatgtctgaccccaggaaattccctttaagctgcttgtcagaggtgcatgctgagagcatgatgggaagatggagtcttccatccactggtaaaatctggaatctgctctcatttcattttcactgaactgaaaataaggtaacagaccctcaggtctacctataagtaccttccaactgttccacttttgtaaatttagttcaaataatacatatgctgaaattcctatatcccccccatactccagatcttcaktgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaa

SEQ ID NO: 78353 - DNA, 601 bp, Human
caggcttaaggctggaagaaaccccaagcatttggccaggaagaggcaactagttccagctggcccacatactacactttaaaaattacccagatgatgtgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgwcccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagt

SEQ ID NO: 78354 - DNA, 601 bp, Human
ggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagct

SEQ ID NO: 78355 - DNA, 601 bp, Human
agcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctctctcggaaatattccttcagtgtattagtaaagaagttacttatgagtcacttatgcccttgaagagtgagtgatgtatcaaaatatgtctgtctttattgtttcactttcatccttctttttttggagatggagtcttgctct

SEQ ID NO: 78356 - DNA, 601 bp, Human
gattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatyctgtctccaagtctgtctgtctgtctgtctgtctgtctgtctctctcggaaatattccttcagtgtattagtaaagaagttacttatgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccacca

SEQ ID NO: 78357 - DNA, 601 bp, Human
tccaagtctgtctgtctgtctgtctgtctgtctgtctctctcggaaatattccttcagtgtattagtaaagaagttacttatgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatgcttacatgtaactgcactttctcatcaactgcaaccataatttagctatggatacaagagttgggcacaaatccatgaaagcattgagtgagaatcaattggctctgtgggat

SEQ ID NO: 78358 - DNA, 601 bp, Human
aaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattga

SEQ ID NO: 78359 - DNA, 601 bp, Human
ctcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtattacagaaaaggaaaaagccatatacatggagaaaaaactcccgatatttaatattatcaattgctggttcctgtaaatttgcatttatggatcacattataaaagcaattactcttatggattgttcatgcagaaatgcattatgatgataatatacttttaaaagtatatttatttccagaattcaatttgtaagaggt

SEQ ID NO: 78360 - DNA, 601 bp, Human
aagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaaaaaactcccgatatttaatattatcaattgctggttcctgtaaatttgcatttatggatcacattataaaagcaattactcttatggattgttcatgcagaaatgcaytatgatgataatatacttttaaaagtatatttatttccagaattcaatttgtaagaggtttgagggaaaaataatactgagttttgagtgtttctgattttaaaaatgtgttcagtagaattaaacgtgttcaccaaaacccattttatccctttaaattattgggcaattaattgtatttacttagcattgaatgcatgattagaaatggaatttttaaaaaagcaatactcaagtggagtgagttcatttgttcattcagcaaataggacttgagtcccctactatgtgcggagcctt

SEQ ID NO: 78361 - DNA, 601 bp, Human
agacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaaaaaactcccgatatttaatattatcaattgctggttcctgtaaatttgcatttatggatcacattataaaagcaattactcttatggattgttcatgcagaaatgcattatgatgatamtatacttttaaaagtatatttatttccagaattcaatttgtaagaggtttgagggaaaaataatactgagttttgagtgtttctgattttaaaaatgtgttcagtagaattaaacgtgttcaccaaaacccattttatccctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgaga

SEQ ID NO: 78362 - DNA, 601 bp, Human
tcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcaagtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaacgggagcgaatagtattttccaaacttacgtcaccacttaccatccacctgcatactttacacgtcttggaatcaaccttacagggaacacttggtcgaaaaacagtgttttctaaatttatat

SEQ ID NO: 78363 - DNA, 601 bp, Human
tcaatgggtagagtttgctttagcttttcaagtatcttactgtatgatggttgcttttgggttgaattccaccttgggttcaattcaacatgaaagttaaccttttggtgaaggaatgatccacgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacgtcttggaatcaaccttacagggaacacttggtcgaaaaacagtgttttctaaatttatattacagttcccactccccccgcccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacct

SEQ ID NO: 78364 - DNA, 601 bp, Human
gaattccaccttgggttcaattcaacatgaaagttaaccttttggtgaaggaatgatccacgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaacgggagcgaatagtattttccaaacttacgtcaccacttaccatccacctgcatactttacacrtcttggaatcaaccttacagggaacacttggtcgaaaaacagtgttttctaaatttatattacagttcccactccccccgcccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaa

SEQ ID NO: 78365 - DNA, 601 bp, Human
gcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaacgggagcgaatagtattttccaaacttacgtcaccacttaccatccacctgcatactttacacgtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttat

SEQ ID NO: 78366 - DNA, 601 bp, Human
gtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacac

SEQ ID NO: 78367 - DNA, 601 bp, Human
tatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcat

SEQ ID NO: 78368 - DNA, 601 bp, Human
tcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctactttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggaggg

SEQ ID NO: 78369 - DNA, 601 bp, Human
tgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttgttattattattaatgttattttttgtttgtttgttttttgagatggagtcttgctctgtcacccaggctgaagtgcagtggcgtgatctcaactcaccgcagcctccgcctcctgggatcaagtgattc

SEQ ID NO: 78370 - DNA, 601 bp, Human
caggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgacc

SEQ ID NO: 78371 - DNA, 601 bp, Human
tattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttgttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagcc

SEQ ID NO: 78372 - DNA, 601 bp, Human
tcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactc

SEQ ID NO: 78373 - DNA, 601 bp, Human
cagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctactttttgtttagctgtttttctaatttaatcttrtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattt

SEQ ID NO: 78374 - DNA, 601 bp, Human
tgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtc

SEQ ID NO: 78375 - DNA, 601 bp, Human
tggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagta

SEQ ID NO: 78376 - DNA, 601 bp, Human
gtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggt

SEQ ID NO: 78377 - DNA, 601 bp, Human
agcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccaaattttcttataaagtcaaatgggagatacttgtttgcaagaaatagttcttttggttcttacttttccataaggattgagtctcaaaatgtctggta

SEQ ID NO: 78378 - DNA, 601 bp, Human
ttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctcatgccattctcctccctcagcctcctgagtagctgggactgcaggcgccagccaccacgccyggctaattttttatatttttagtagagacggggtttcaccatgctaaccaggatggtctcgatctcctgacctcgtgatccaccagccttggcctcccaaagtgctgggattacaggcattagccaccacacccggcccaaattttcttataaagtcaaatgggagatacttgtttgcaagaaatagttcttttggttcttacttttccataaggattgagtctcaaaatgtctggtagcatccactgcattttgtaggggacaataacaaagaagatgccagcaatatcttctatcttt

SEQ ID NO: 78379 - DNA, 601 bp, Human
ttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctcatgccattctcctccctcagcctcctgagtagctgggactgcaggcgccagccaccacgcccggctaattttttatatttttagtmgagacggggtttcaccatgctaaccaggatggtctcgatctcctgacctcgtgatccaccagccttggcctcccaaagtgctgggattacaggcattagccaccacacccggcccaaattttcttataaagtcaaatgggagatacttgtttgcaagaaatagttcttttggttcttacttttccataaggattgagtctcaaaatgtctggtagcatccactgcattttgtaggggacaataacaaagaagatgccagcaatatcttctatcttttccaacattattcacctctcccac

SEQ ID NO: 78380 - DNA, 601 bp, Human
ggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtggcggaagaaagtgagatcagagatcccgagga

SEQ ID NO: 78381 - DNA, 601 bp, Human
atcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatsatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggcc

SEQ ID NO: 78382 - DNA, 601 bp, Human
tggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacaygtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgacc

SEQ ID NO: 78383 - DNA, 601 bp, Human
cctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagargtttcccaacagtatttcggtgtgcatgctcacacaccagccctggtcgtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagc

SEQ ID NO: 78384 - DNA, 601 bp, Human
ttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcrtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggccta

SEQ ID NO: 78385 - DNA, 601 bp, Human
aaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtrgcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaa

SEQ ID NO: 78386 - DNA, 601 bp, Human
tgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcaggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcc

SEQ ID NO: 78387 - DNA, 601 bp, Human
tttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagctagggcaggtgcaatggctcacgcctataatcccagcac

SEQ ID NO: 78388 - DNA, 601 bp, Human
cccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcaggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagctagggcaggtgcaatggctcacgcctataatcccagcactttgggaggccgaggcaggtggatcacctgaggtcaggagttcaagaccagcctgaccaacatggtgaaaccccatctctactaacaataca

SEQ ID NO: 78389 - DNA, 601 bp, Human
tggatcctctgctctaggacacattcttgtcctagagcaggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagckagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtag

SEQ ID NO: 78390 - DNA, 601 bp, Human
cattcttgtcctagagcaggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagctagggcaggtgcaatggctcaygcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccc

SEQ ID NO: 78391 - DNA, 601 bp, Human
ctcctgcttaggaaatttgggttgagggtggcagtgatcttgaggggggtctgggagggaggagccagcctggcctggtctggcctggcccagtgtgccagctagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacaactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctct

SEQ ID NO: 78392 - DNA, 601 bp, Human
gaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgctacatttaatctttatggtagcctcatgaacaggctcttatttagttcagtggttcttgatcaggagtgatattgcctgccagggaatgcatgtcaatgtctggagacatctggggttgtcagttcaggagggtagaggataggggggaaaaggtg

SEQ ID NO: 78393 - DNA, 601 bp, Human
ttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaactgcactctcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgc

SEQ ID NO: 78394 - DNA, 601 bp, Human
aggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaatgaggtctcat

SEQ ID NO: 78395 - DNA, 601 bp, Human
cctttgcaggcaggaagtggagtgcggatgctggaactagctggctgctttggtgccagtagaggtgaactgcactctcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaatgaggtctcatgagcaaattttaaggatggcaaatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtt

SEQ ID NO: 78396 - DNA, 601 bp, Human
ctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcatartaatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcgtgagtcttggcatctttttg

SEQ ID NO: 78397 - DNA, 601 bp, Human
ggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtrgataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcgtgagtcttggcatctttttggtagagaaccttgctaggttctcac

SEQ ID NO: 78398 - DNA, 601 bp, Human
agctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcgtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcata

SEQ ID NO: 78399 - DNA, 601 bp, Human
caggtgaatcacttgaggtcaggagttcgagactagcctggccaacatggtgaaaccctgtctctactaaaaatacaaaattttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaa

SEQ ID NO: 78400 - DNA, 601 bp, Human
tttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacag

SEQ ID NO: 78401 - DNA, 601 bp, Human
gaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccaccc

SEQ ID NO: 78402 - DNA, 601 bp, Human
gaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagc

SEQ ID NO: 78403 - DNA, 601 bp, Human
caaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttt

SEQ ID NO: 78404 - DNA, 601 bp, Human
taaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttkggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgc

SEQ ID NO: 78405 - DNA, 601 bp, Human
gtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgctwctgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggta

SEQ ID NO: 78406 - DNA, 601 bp, Human
ggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgctactgataaagrcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggtacacagccaaa

SEQ ID NO: 78407 - DNA, 601 bp, Human
gatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgctactgataaaggcayacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggtacacagccaaacca

SEQ ID NO: 78408 - DNA, 601 bp, Human
catgaacatgctttgtaattttttttaaggattgatactagctagggtgttgataagaaacagcaggcatagttactgggtgattgagaagagtttaacaaaagactatattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccrtcagattccttgagacttatttgctattgtgagaacaccttgggaaagacctgcctccatgattcaattacctcccacctggtccctcctgcaacatgtgggaattcaagaagagatttgggtgggtacacagccaaaccatatcaaaaaccatttacaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacct

SEQ ID NO: 78409 - DNA, 601 bp, Human
tgctttgtaattttttttaaggattgatactagctagggtgttgataagaaacagcaggcatagttactgggtgattgagaagagtttaacaaaagactatattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattycttgagacttatttgctattgtgagaacaccttgggaaagacctgcctccatgattcaattacctcccacctggtccctcctgcaacatgtgggaattcaagaagagatttgggtgggtacacagccaaaccatatcaaaaaccatttacaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggt

SEQ ID NO: 78410 - DNA, 601 bp, Human
agaaacagcaggcatagttactgggtgattgagaagagtttaacaaaagactatattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcytccatgattcaattacctcccacctggtccctcctgcaacatgtgggaattcaagaagagatttgggtgggtacacagccaaaccatatcaaaaaccatttacaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcc

SEQ ID NO: 78411 - DNA, 601 bp, Human
tttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagag

SEQ ID NO: 78412 - DNA, 601 bp, Human
acaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggta

SEQ ID NO: 78413 - DNA, 601 bp, Human
tcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcaga

SEQ ID NO: 78414 - DNA, 601 bp, Human
aatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatycccaaaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaa

SEQ ID NO: 78415 - DNA, 601 bp, Human
gctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccraaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgtt

SEQ ID NO: 78416 - DNA, 601 bp, Human
tacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccasattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagcc

SEQ ID NO: 78417 - DNA, 601 bp, Human
gatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggtttggacaagcytagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagccccctcccgaatgcgtcctcagaactcgctggttctcgtcctcgccctcagcata

SEQ ID NO: 78418 - DNA, 601 bp, Human
ctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagccccctcccgaatgcrtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatactagaatcatt

SEQ ID NO: 78419 - DNA, 601 bp, Human
tacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagccccctcccgaatgcgtcctcagaactcgctggttctcgtcctcgccctcagcatacttgctcattgtttgtttccatctctatcatctctgtgagccctttgaggatggatgtgtgtccatsttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatactagaatcattgaatccctgagttatagaaaaatttattaatagcgctatctggctactttttaaagtgtggacatcctcgatgtattagctatgcatctgtggataggaggcttacc

SEQ ID NO: 78420 - DNA, 601 bp, Human
tagccccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaarataaatactagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaccct

SEQ ID NO: 78421 - DNA, 601 bp, Human
tttcaagagtggcattttggcatgattggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttyaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcccccaagttcctgtccgctggtagaattcacaaagctggttttatgtctccttct

SEQ ID NO: 78422 - DNA, 601 bp, Human
gcattttggcatgattggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttcaagcgattccmctgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcccccaagttcctgtccgctggtagaattcacaaagctggttttatgtctccttctcttcctcttcc

SEQ ID NO: 78423 - DNA, 601 bp, Human
ggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgcatggagatccttgtactcctcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgcttt

SEQ ID NO: 78424 - DNA, 601 bp, Human
ctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcccccaagttcctgtccgctggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccc

SEQ ID NO: 78425 - DNA, 601 bp, Human
tgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgcgtagcttcatcatagatctcagcttaaggacaatgaaagtcgtttattgagtacttagtatgtgctggttgcagagccaagtcttttttttttttttttttttcctccttttttgagagagagagt

SEQ ID NO: 78426 - DNA, 601 bp, Human
caccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccmaaaaaaaaaaaaaaaaaaaaaaaaaagcggggcaaggggttggagaatgttcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctc

SEQ ID NO: 78427 - DNA, 601 bp, Human
caggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaagyggggcaaggggttggagaatgttcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgag

SEQ ID NO: 78428 - DNA, 601 bp, Human
ctgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaagcggggcaaggggttggagaatgttcatatcacattattttggatgtctggggttgcacctggaagctcagatagcaatatctaggcacggctgccagygctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctg

SEQ ID NO: 78429 - DNA, 601 bp, Human
agcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaagcggggcaaggggttggagaatgttcatatcacattattttggatgtctggggttgcacctggaagctcagatagcaatatctaggcacggctgccagtgctctatacattsacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctgtgtttgacatcga

SEQ ID NO: 78430 - DNA, 601 bp, Human
gtccattctctagccttctgaagaagatagattgtaatctttaattaagctatcactcacaccaaaaaaaaaaaaaaaaaaaaaaaaaaagcggggcaaggggttggagaatgttcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctgtgtttgacatcgagatagaatttttcataaccctttactagtaataaatttgattgttaagggaccgggttaatcttatttctaataccagcatctgattttaaaaccctga

SEQ ID NO: 78431 - DNA, 601 bp, Human
tcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctgtgtttgacatcgagatagaatttttcataaccctttactagtaataaatttgattgttaagggaccgggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagta

SEQ ID NO: 78432 - DNA, 601 bp, Human
tgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctrtgtttgacatcgagatagaatttttcataaccctttactagtaataaatttgattgttaagggaccgggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaata

SEQ ID NO: 78433 - DNA, 601 bp, Human
tgaatagtacctatgagatgcatttgaaaacttaccttgtttatatgtttcttctgttgcaatttcttccattacctggaatagctgctttggacggcaaaccaagcaatgccctttcacaggtgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacggcattattttagggggagaggttagagtagaattttaaagagtgcatttctcttcc

SEQ ID NO: 78434 - DNA, 601 bp, Human
gaatttcccgattctcttccacgtgtggacagattggcacatatgtgtgtgtgcaaattgtacttgcagtggctgcctgggaaatgaaatttctgcaccttgccagagcatgttttccctctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcmgattcagtacatatttataaaaccacacttacatttaaatacaggcctttcccatttcacagtgtttctagctcccctttccaatacatctctctctctctttctctctctctctctctctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaa

SEQ ID NO: 78435 - DNA, 601 bp, Human
ttcccgattctcttccacgtgtggacagattggcacatatgtgtgtgtgcaaattgtacttgcagtggctgcctgggaaatgaaatttctgcaccttgccagagcatgttttccctctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgatycagtacatatttataaaaccacacttacatttaaatacaggcctttcccatttcacagtgtttctagctcccctttccaatacatctctctctctctttctctctctctctctctctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaat

SEQ ID NO: 78436 - DNA, 601 bp, Human
ttccacgtgtggacagattggcacatatgtgtgtgtgcaaattgtacttgcagtggctgcctgggaaatgaaatttctgcaccttgccagagcatgttttccctctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatattyataaaaccacacttacatttaaatacaggcctttcccatttcacagtgtttctagctcccctttccaatacatctctctctctctttctctctctctctctctctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatg

SEQ ID NO: 78437 - DNA, 601 bp, Human
tctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatatttataaaaccacacttacatttaaatacaggcctttcccatttcacagtgtttctagctcccctttccaatacatctctctctctctttctctctctctctctcwctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctct

SEQ ID NO: 78438 - DNA, 601 bp, Human
taaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatatttataaaaccacacttacatttaaatacaggcctttcccatttcacagtgtttctagctcccctttccaatacatctctctctctctttctctctctctctctctcwctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctcttt

SEQ ID NO: 78439 - DNA, 601 bp, Human
tgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatatttataaaaccacacttacatttaaatacaggcctttcccatttcacagtgtttctagctcccctttccaatacatctctctctctctttctctctctctctctctctctctcacacacacaacacacacacacacacaccgccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttct

SEQ ID NO: 78440 - DNA, 601 bp, Human
tctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagwgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtag

SEQ ID NO: 78441 - DNA, 601 bp, Human
atgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaata

SEQ ID NO: 78442 - DNA, 601 bp, Human
tacaaaattgcacatactctataaatacacttctgttataaaaatagacacgtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaa

SEQ ID NO: 78443 - DNA, 601 bp, Human
aaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgc

SEQ ID NO: 78444 - DNA, 601 bp, Human
tccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttyacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagatccaagaccttaacttt

SEQ ID NO: 78445 - DNA, 601 bp, Human
accctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttacctacaaccttattaagtagacattatcttcatcttattaagtagtcagttcctcatttgcagatgaggaaactggctgac

SEQ ID NO: 78446 - DNA, 601 bp, Human
agcttctagtagtagggcttagaggttcctagagtaggaaaagcctagccaagcagaaacccatgtttttgactttcaggatatttgtgaattaatttacttgcatatattggccaagatctagcataatctcttaatattcagtgaataaaaaattgagttttgagagcaaatattttggtaggaaatagagaactgacactaatattctctctgactataattgtaaaacagtagatgtctttcaccaagcgctaacattatattaattattaataaaatccaactccttaataatacwatcatagttaccatttattgagagcactcttctgaacattttgcattctttatttaatcttacctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggc

SEQ ID NO: 78447 - DNA, 601 bp, Human
atgtttttgactttcaggatatttgtgaattaatttacttgcatatattggccaagatctagcataatctcttaatattcagtgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcct

SEQ ID NO: 78448 - DNA, 601 bp, Human
cattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacac

SEQ ID NO: 78449 - DNA, 601 bp, Human
gtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatctatctctacaaaaaatttaaaaattagctgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattc

SEQ ID NO: 78450 - DNA, 601 bp, Human
tatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgagga

SEQ ID NO: 78451 - DNA, 601 bp, Human
gtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgtt

SEQ ID NO: 78452 - DNA, 601 bp, Human
gctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacwtacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacattt

SEQ ID NO: 78453 - DNA, 601 bp, Human
acacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacatacsaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacattttttt

SEQ ID NO: 78454 - DNA, 601 bp, Human
ggcaggagaatcacttgaacccaggaggtggaggttgcagtgagctgagatcacaccactgcactccagcctgggtgacagagcaagactgtctcaaaaaaaaaaaaaaaaaaaaaaaaattcaacatacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgtt

SEQ ID NO: 78455 - DNA, 601 bp, Human
tggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgt

SEQ ID NO: 78456 - DNA, 601 bp, Human
agtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccayccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaa

SEQ ID NO: 78457 - DNA, 601 bp, Human
aggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaasctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtt

SEQ ID NO: 78458 - DNA, 601 bp, Human
ggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaagytttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgttt

SEQ ID NO: 78459 - DNA, 601 bp, Human
ataataagtgagcagtatggcgccctaatagaaggagggatgcctgtggccaatatacacggctcaaagttgaccatgatagagaagctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttgg

SEQ ID NO: 78460 - DNA, 601 bp, Human
ttatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatatatacacatatatgcacagtaatagatataggtaaagaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgc

SEQ ID NO: 78461 - DNA, 601 bp, Human
ataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaatttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattg

SEQ ID NO: 78462 - DNA, 601 bp, Human
gccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattgtcgcacctcagcctcccaagtaactgggattacaggtgcccaccaccaagcccggctaatttttstattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaataccc

SEQ ID NO: 78463 - DNA, 601 bp, Human
ccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattgtcgcacctcagcctcccaagtaactgggattacaggtgcccaccaccaagcccggctaatttttctattttmaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttg

SEQ ID NO: 78464 - DNA, 601 bp, Human
tttttcgagatggactttcgcttttttgcccagcctggagtgaagtggcatgatctcggctcactgcaaactacccccgcccccgggttcaagcaattgtcgcacctcagcctcccaagtaactgggattacaggtgcccaccaccaagcccggctaatttttctattttcaatagagatgaggttttgccatattggtcaggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaa

SEQ ID NO: 78465 - DNA, 601 bp, Human
aagtggcatgatctcggctcactgcaaactacccccgcccccgggttcaagcaattgtcgcacctcagcctcccaagtaactgggattacaggtgcccaccaccaagcccggctaatttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtsctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttg

SEQ ID NO: 78466 - DNA, 601 bp, Human
gatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagc

SEQ ID NO: 78467 - DNA, 601 bp, Human
ggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttca

SEQ ID NO: 78468 - DNA, 601 bp, Human
ggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattct

SEQ ID NO: 78469 - DNA, 601 bp, Human
ggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatccta

SEQ ID NO: 78470 - DNA, 601 bp, Human
agcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggct

SEQ ID NO: 78471 - DNA, 601 bp, Human
tggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttt

SEQ ID NO: 78472 - DNA, 601 bp, Human
attgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattatactccagtctaggcaacaagagtgaaactctgtctcaaaaaaattaataataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggaga

SEQ ID NO: 78473 - DNA, 601 bp, Human
tagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagc

SEQ ID NO: 78474 - DNA, 601 bp, Human
tttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctccsagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaa

SEQ ID NO: 78475 - DNA, 601 bp, Human
tgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaag

SEQ ID NO: 78476 - DNA, 601 bp, Human
gcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctstagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttgg

SEQ ID NO: 78477 - DNA, 601 bp, Human
aatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatygctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccc

SEQ ID NO: 78478 - DNA, 601 bp, Human
tgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaact

SEQ ID NO: 78479 - DNA, 601 bp, Human
tccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttmcttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagct

SEQ ID NO: 78480 - DNA, 601 bp, Human
ttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttmtttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgct

SEQ ID NO: 78481 - DNA, 601 bp, Human
atgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatackctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaat

SEQ ID NO: 78482 - DNA, 601 bp, Human
tttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgt

SEQ ID NO: 78483 - DNA, 601 bp, Human
catgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaa

SEQ ID NO: 78484 - DNA, 601 bp, Human
aagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagatrccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagag

SEQ ID NO: 78485 - DNA, 601 bp, Human
acgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgc

SEQ ID NO: 78486 - DNA, 601 bp, Human
ctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctcccca

SEQ ID NO: 78487 - DNA, 601 bp, Human
aaggcaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgg

SEQ ID NO: 78488 - DNA, 601 bp, Human
ggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcastctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcac

SEQ ID NO: 78489 - DNA, 601 bp, Human
gtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcatt

SEQ ID NO: 78490 - DNA, 601 bp, Human
caataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaacc

SEQ ID NO: 78491 - DNA, 601 bp, Human
agcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcg

SEQ ID NO: 78492 - DNA, 601 bp, Human
tggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcrttgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgtgtgaaatttacaccttttcaaattttgaaaa

SEQ ID NO: 78493 - DNA, 601 bp, Human
tattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgygtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctca

SEQ ID NO: 78494 - DNA, 601 bp, Human
attgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgtrtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcat

SEQ ID NO: 78495 - DNA, 601 bp, Human
taatttatcataaaccatttaaggagcagttggagaaaagggggaaaaagttaaatgttaatgattcttttcgtaactgcaattttatcggctcctttttgtacatatatgattatgaagcaatttgtgtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaa

SEQ ID NO: 78496 - DNA, 601 bp, Human
ttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatg

SEQ ID NO: 78497 - DNA, 601 bp, Human
gacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttg

SEQ ID NO: 78498 - DNA, 601 bp, Human
aggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtrtcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttctt

SEQ ID NO: 78499 - DNA, 601 bp, Human
gcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtcctt

SEQ ID NO: 78500 - DNA, 601 bp, Human
cgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagt

SEQ ID NO: 78501 - DNA, 601 bp, Human
tcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtg

SEQ ID NO: 78502 - DNA, 601 bp, Human
ttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgaatataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaa

SEQ ID NO: 78503 - DNA, 601 bp, Human
tgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctc

SEQ ID NO: 78504 - DNA, 601 bp, Human
gcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgagcaaaagacacagaaaggatttctttatcgtaagcacacttctctacattacctttataatccaacaactctgstattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagt

SEQ ID NO: 78505 - DNA, 601 bp, Human
cgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttct

SEQ ID NO: 78506 - DNA, 601 bp, Human
attcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttratctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaat

SEQ ID NO: 78507 - DNA, 601 bp, Human
acctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggtttta

SEQ ID NO: 78508 - DNA, 601 bp, Human
tcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgg

SEQ ID NO: 78509 - DNA, 601 bp, Human
caggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaac

SEQ ID NO: 78510 - DNA, 601 bp, Human
taaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaa

SEQ ID NO: 78511 - DNA, 601 bp, Human
gggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggt

SEQ ID NO: 78512 - DNA, 601 bp, Human
ggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaa

SEQ ID NO: 78513 - DNA, 601 bp, Human
tcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctc

SEQ ID NO: 78514 - DNA, 601 bp, Human
ccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaracgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgat

SEQ ID NO: 78515 - DNA, 601 bp, Human
tgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattaycctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaat

SEQ ID NO: 78516 - DNA, 601 bp, Human
ttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaag

SEQ ID NO: 78517 - DNA, 601 bp, Human
atcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagag

SEQ ID NO: 78518 - DNA, 601 bp, Human
tacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctctctctctgtttattatagatagaaataaaaaaattataaatagaaatttatttctcatggttctagaggctggaaaattcaagatcaagatgcagacaggcttggtg

SEQ ID NO: 78519 - DNA, 601 bp, Human
cttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaatttatttctcatggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggc

SEQ ID NO: 78520 - DNA, 601 bp, Human
tgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttaggg

SEQ ID NO: 78521 - DNA, 601 bp, Human
tgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggct

SEQ ID NO: 78522 - DNA, 601 bp, Human
gaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctcta

SEQ ID NO: 78523 - DNA, 601 bp, Human
cttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccactgaccactctctgtacagatgcgctcaagcgaccataaccaccagtgttcctaacaatgcgcctattgacttcttatttcaatagatatccagatttattatccctcaaggtaagcatcgattt

SEQ ID NO: 78524 - DNA, 601 bp, Human
ccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggrgtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaa

SEQ ID NO: 78525 - DNA, 601 bp, Human
tggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggawcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtg

SEQ ID NO: 78526 - DNA, 601 bp, Human
cttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagacca

SEQ ID NO: 78527 - DNA, 601 bp, Human
gagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtawagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagaccagtcacagt

SEQ ID NO: 78528 - DNA, 601 bp, Human
atttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcttgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtac

SEQ ID NO: 78529 - DNA, 601 bp, Human
atgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctg

SEQ ID NO: 78530 - DNA, 601 bp, Human
cccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttga

SEQ ID NO: 78531 - DNA, 601 bp, Human
ccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgac

SEQ ID NO: 78532 - DNA, 601 bp, Human
ccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtc

SEQ ID NO: 78533 - DNA, 601 bp, Human
cacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtctttttttt

SEQ ID NO: 78534 - DNA, 601 bp, Human
agtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggctkggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtct

SEQ ID NO: 78535 - DNA, 601 bp, Human
atagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggytgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtcttctccttgcttcaaccctccccgctgacagccacaag

SEQ ID NO: 78536 - DNA, 601 bp, Human
aaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagataggg

SEQ ID NO: 78537 - DNA, 601 bp, Human
gttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggc

SEQ ID NO: 78538 - DNA, 601 bp, Human
agacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatcta

SEQ ID NO: 78539 - DNA, 601 bp, Human
aaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagatamttagcatagccatcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgtt

SEQ ID NO: 78540 - DNA, 601 bp, Human
cagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtatatata

SEQ ID NO: 78541 - DNA, 601 bp, Human
gtctttggtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtttattcccctcgtcagcatactttatcatatcaaagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttc

SEQ ID NO: 78542 - DNA, 601 bp, Human
atttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtctt

SEQ ID NO: 78543 - DNA, 601 bp, Human
aactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtg

SEQ ID NO: 78544 - DNA, 601 bp, Human
gtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatgagatttggatagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatct

SEQ ID NO: 78545 - DNA, 601 bp, Human
actatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgyaaacactgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacc

SEQ ID NO: 78546 - DNA, 601 bp, Human
ttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgtaaacwctgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtgg

SEQ ID NO: 78547 - DNA, 601 bp, Human
agccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcrgaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttg

SEQ ID NO: 78548 - DNA, 601 bp, Human
ttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactg

SEQ ID NO: 78549 - DNA, 601 bp, Human
atgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctgg

SEQ ID NO: 78550 - DNA, 601 bp, Human
aacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccc

SEQ ID NO: 78551 - DNA, 601 bp, Human
ataactgtctccttactctgtgctcttgccccaggcagagtggaagttgccttataaagctgcgacttggccacagtgttttccctttcagcagggaaaccggagttctccgtgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttactatatgctcgaaacgatttaactagcagcaataaaatctctactctttttatgacaaataatctagcatgtctggggagcatatttgattcttca

SEQ ID NO: 78552 - DNA, 601 bp, Human
tggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagata

SEQ ID NO: 78553 - DNA, 601 bp, Human
ggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagccatctgctaatccctgtgatttaaaaatgtgcgtgtttttagtttctgtctaatttcaaccttttcttgct

SEQ ID NO: 78554 - DNA, 601 bp, Human
tgaaagacatctccttctcatatgtttaggcaagcgttgatgacatcaacctagccttttattttaaatcccctgtcaacgcaattagataatacaaaaataacaaaactataggaggttgaggatggggctgggggccaaggagattacttggtttgaaatgaataaattgtctatcgtaagggaattctttggtgcattttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaag

SEQ ID NO: 78555 - DNA, 601 bp, Human
agaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtaaaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcat

SEQ ID NO: 78556 - DNA, 601 bp, Human
cattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtagg

SEQ ID NO: 78557 - DNA, 601 bp, Human
acatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaamatgagtgctcaagaaatagtaaattttagtatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccat

SEQ ID NO: 78558 - DNA, 601 bp, Human
gtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaacatgagtgctcaagaaatagtaaattttartatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgccca

SEQ ID NO: 78559 - DNA, 601 bp, Human
ctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctcc

SEQ ID NO: 78560 - DNA, 601 bp, Human
tcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatct

SEQ ID NO: 78561 - DNA, 601 bp, Human
agctcagtagtcatgacagtaaccatatgcccacaaagcctaaaatatttactatctggctctttgcagaaaatgcgctgaaccttgcgtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcaatgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcagggg

SEQ ID NO: 78562 - DNA, 601 bp, Human
tgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgccttt

SEQ ID NO: 78563 - DNA, 601 bp, Human
ttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaac

SEQ ID NO: 78564 - DNA, 601 bp, Human
gttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgagg

SEQ ID NO: 78565 - DNA, 601 bp, Human
taaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggasacattcagaccacaataatgttttataatgttccttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaaga

SEQ ID NO: 78566 - DNA, 601 bp, Human
taatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttcmttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaataga

SEQ ID NO: 78567 - DNA, 601 bp, Human
aggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttccttttgctttaacaagagacacatgtcagatagtagacatgatctgagaagacacaaaacccagcgtggtgattttggcagccttgccatgcatctctaacatgcacrtggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgaca

SEQ ID NO: 78568 - DNA, 601 bp, Human
taaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatc

SEQ ID NO: 78569 - DNA, 601 bp, Human
cattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaag

SEQ ID NO: 78570 - DNA, 601 bp, Human
gttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatgactcactgaaggccacagcacaaagtggggacttgagtcc

SEQ ID NO: 78571 - DNA, 601 bp, Human
cttggaggcaggaaatgactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgta

SEQ ID NO: 78572 - DNA, 601 bp, Human
acagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagagaattccccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgc

SEQ ID NO: 78573 - DNA, 601 bp, Human
gtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattcca

SEQ ID NO: 78574 - DNA, 601 bp, Human
agggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaa

SEQ ID NO: 78575 - DNA, 601 bp, Human
tttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagcatctcactgtatttttatttttttctacattgcaatttcaaaataatccaactcaaaggctgttgaaaggctccttctgtttaaggtaaagcctgtggcagcctttaacttcctttctcttctcctgctgccaccttggtccacaatttatctttgaaaatgctgggttttaatgggcagggtatagtgcagaaaccagat

SEQ ID NO: 78576 - DNA, 601 bp, Human
tgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattggccagtatattcaatgattcacttgcacctttaaccttgtgttgttctaatctttttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctg

SEQ ID NO: 78577 - DNA, 601 bp, Human
acagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtcatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgacca

SEQ ID NO: 78578 - DNA, 601 bp, Human
tgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttacagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtgacaaagtctttgctctacaggtcaagttgggacttactgaggagaaatgaggggacttcaaa

SEQ ID NO: 78579 - DNA, 601 bp, Human
aaaatcagccaggcatggtggcgcatgcttgtagtcccagcgacttgagaggctgagggatgagaatcacttgaacccgagaggcaggggttacagtgagtgcggtggcagctgggacattaaccaagttgtgaaaggagccatgatgttattagctgagtcatgtcactgcacctccagcctgggcaacagagtcagactctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtgacaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaa

SEQ ID NO: 78580 - DNA, 601 bp, Human
tgcggtggcagctgggacattaaccaagttgtgaaaggagccatgatgttattagctgagtcatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaat

SEQ ID NO: 78581 - DNA, 601 bp, Human
gagtcatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtgacaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgt

SEQ ID NO: 78582 - DNA, 601 bp, Human
cccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttgccctcacaggacaatatctttaatagcttctgtgtgtttcctatttttggctgtttctgtataaacagactaatctaatagcatactgaacccatctaacttggcagaaattcagaaaatcactcatttctatggcaag

SEQ ID NO: 78583 - DNA, 601 bp, Human
attttctaatcttttttttttttttttcgtggaatcatgttcccttcggaaaactccctgggtgccccagcattatgtggtaaaggacatgtatttccaactggcaggggctctgcaaagtttctctgcctcctttgctcaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggta

SEQ ID NO: 78584 - DNA, 601 bp, Human
ctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttc

SEQ ID NO: 78585 - DNA, 601 bp, Human
tgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctacatggaatatttgtgtcttctcccccatttatttatttaatcatttatttatatcacggtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccacttt

SEQ ID NO: 78586 - DNA, 601 bp, Human
gtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacctgattggccacctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctatgatcctgtaagtctttgaataatggcccaggatgcc

SEQ ID NO: 78587 - DNA, 601 bp, Human
atgtggactggggagagaagagtcattgacagggacaagaaataaataactttgatgcaaatcctgggaagactctggaacaacatggaggcacctatgttaactctatttcattttggaaaagttgagtagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggag

SEQ ID NO: 78588 - DNA, 601 bp, Human
gccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagag

SEQ ID NO: 78589 - DNA, 601 bp, Human
gatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttwttttttttttcctctgcaagggatggggtcataagacattggtgaggttaggccttcctttgtctcccaggagcacacttgatagcaatgtagggtgaattccaaatctgtgagttagtgccatatatagcagtgttgtcagtaagatttctcactggcatctctgcttcccctcttgactctcttgaaatcccttcttcaggcagaagttggagtcatttctctaaaatagaaatctgatcttgccaccaccctacttgccactccctgcttaatcccttcactggctcaccatatccc

SEQ ID NO: 78590 - DNA, 601 bp, Human
ccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcac

SEQ ID NO: 78591 - DNA, 601 bp, Human
ataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggt

SEQ ID NO: 78592 - DNA, 601 bp, Human
cacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactggstgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatt

SEQ ID NO: 78593 - DNA, 601 bp, Human
tgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagt

SEQ ID NO: 78594 - DNA, 601 bp, Human
attcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacg

SEQ ID NO: 78595 - DNA, 601 bp, Human
tttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagct

SEQ ID NO: 78596 - DNA, 601 bp, Human
tcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgattkaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagc

SEQ ID NO: 78597 - DNA, 601 bp, Human
gccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgattccagggattgttttggaggggagtgaggaataaatgatataattcactaaaacacgtagaatagtatttgacac

SEQ ID NO: 78598 - DNA, 601 bp, Human
ttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggcc

SEQ ID NO: 78599 - DNA, 601 bp, Human
aataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccaattttttttttttttttttttttttttggkggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgat

SEQ ID NO: 78600 - DNA, 601 bp, Human
ttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgttttccttcccactcacatgtaggtcacctacgggagcaggggaggaaccatctgaggtgtttttttttttttttttagatttctcattgctgagaacagttccagctctgctgaccaaaggctgagtgtccttttattagtctgagcccctagagaraccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtcc

SEQ ID NO: 78601 - DNA, 601 bp, Human
tcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttcaaagttctagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggc

SEQ ID NO: 78602 - DNA, 601 bp, Human
ctgttcaaagttctagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttwaaaaaaaaaaaaaaaaaagttctaaatcagtggattctgccgataaacatcatctggacggaatgaagctgagggccaatagtttagaggctcagcacccgactggagagagagagagagagagagagagagtgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgcttt

SEQ ID NO: 78603 - DNA, 601 bp, Human
ctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagwgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaa

SEQ ID NO: 78604 - DNA, 601 bp, Human
actaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgwgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaac

SEQ ID NO: 78605 - DNA, 601 bp, Human
taaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgwgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactg

SEQ ID NO: 78606 - DNA, 601 bp, Human
aaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgtatgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgt

SEQ ID NO: 78607 - DNA, 601 bp, Human
ttagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagcccagggcctattgtgttgtgtgtgtctccactttccagcctttgggaacgcagagggggacctctgtaattggtaccag

SEQ ID NO: 78608 - DNA, 601 bp, Human
aagacataggcccaggagtctgtgtttgttctttaaacctctctattcagttgcccagctcttttcattccctgtcctttccccctctggctgggtctgcctttccaaccgctaccaccttccaccaccattttttttttgtttcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagattccactcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaa

SEQ ID NO: 78609 - DNA, 601 bp, Human
gtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcagaattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaagaaagaaggggccgggcatggtggctcacgcctgtaatcctaacattttgggaggtcgaggcaggcagattgcctgagctcaggagttgaataccagcctgggcaacacggtgaaaccccgactctactaaaatacaaaaaattagc

SEQ ID NO: 78610 - DNA, 601 bp, Human
ttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgca

SEQ ID NO: 78611 - DNA, 601 bp, Human
ttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacatgaataattatcatctatcaaatttt

SEQ ID NO: 78612 - DNA, 601 bp, Human
ataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacat

SEQ ID NO: 78613 - DNA, 601 bp, Human
tctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttg

SEQ ID NO: 78614 - DNA, 601 bp, Human
ctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacactagtaggtacagcaggagagcatgtagaagaggatagatgtagaaaatcgggacggcatgttaggaatatagataggaattactaaggaaaattgtatttttgtggaattctttgaactcgtt

SEQ ID NO: 78615 - DNA, 601 bp, Human
tctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagcctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggc

SEQ ID NO: 78616 - DNA, 601 bp, Human
tcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccgga

SEQ ID NO: 78617 - DNA, 601 bp, Human
ccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtacc

SEQ ID NO: 78618 - DNA, 601 bp, Human
aattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatytcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtc

SEQ ID NO: 78619 - DNA, 601 bp, Human
cgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtc

SEQ ID NO: 78620 - DNA, 601 bp, Human
atcctgggtctagctggggacatccttgaatcagcctctgggaatcactgaaccaacatgagtcacttgctactgtgagatctcagaacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataacagctaccatttcctgagggcatactgagtgctgacaggcacatcaacatcagaccatcaccttcttatacctcaaaatagtctgcagggtgactcagaagctcctggctggtaagtggcaga

SEQ ID NO: 78621 - DNA, 601 bp, Human
gaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaa

SEQ ID NO: 78622 - DNA, 601 bp, Human
caacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgagg

SEQ ID NO: 78623 - DNA, 601 bp, Human
actggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctc

SEQ ID NO: 78624 - DNA, 601 bp, Human
ctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtc

SEQ ID NO: 78625 - DNA, 601 bp, Human
gtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggttccctttgtttatttttacactagctttgcactaggttaattt

SEQ ID NO: 78626 - DNA, 601 bp, Human
aggcgcccaccaccaagcccagctaatttttttggttttttttgtattttagtagagacgggatttcaccatgttggccaggctggtctcaaactctggacctcaaatgatccaaccgcctcggacttccaaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctactgccccaggctcttcccccgtttgttaatacataccatgaccttggcctttcccacctcttaggttttgcttactttcccttctgtcctttacttatgactctgcccccttttgacctctgctaaaattatttgttactgttgttatgtt

SEQ ID NO: 78627 - DNA, 601 bp, Human
gagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagctgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccaca

SEQ ID NO: 78628 - DNA, 601 bp, Human
ggacaaatgaacgcagattaaggaaaataaaaaagagtgtttggctaacttgcataaaaaggatctcatttttctttgtaacacattactacatacagtgaccatagtgtttctctaatttcttcaggacgtactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgc

SEQ ID NO: 78629 - DNA, 601 bp, Human
taacttgcataaaaaggatctcatttttctttgtaacacattactacatacagtgaccatagtgtttctctaatttcttcaggacgtactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccct

SEQ ID NO: 78630 - DNA, 601 bp, Human
aaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcag

SEQ ID NO: 78631 - DNA, 601 bp, Human
gtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaragaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagat

SEQ ID NO: 78632 - DNA, 601 bp, Human
ttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaaraaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagattt

SEQ ID NO: 78633 - DNA, 601 bp, Human
gcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcayataagtaaattatatgattggacccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattggg

SEQ ID NO: 78634 - DNA, 601 bp, Human
acctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggayccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacataga

SEQ ID NO: 78635 - DNA, 601 bp, Human
tgaacttttgttatttgattatggtgataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcct

SEQ ID NO: 78636 - DNA, 601 bp, Human
tgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcrggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggaca

SEQ ID NO: 78637 - DNA, 601 bp, Human
cttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtamaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagag

SEQ ID NO: 78638 - DNA, 601 bp, Human
attttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctct

SEQ ID NO: 78639 - DNA, 601 bp, Human
tccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcarttgcacaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtg

SEQ ID NO: 78640 - DNA, 601 bp, Human
aggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcrcaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcc

SEQ ID NO: 78641 - DNA, 601 bp, Human
ctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcacaattcacacaccaggctgccactttggcccctgcgtcaccttcaccaccacccaatgtgtcctgctcatcactgaggtttgtcatttttactctgagwctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtca

SEQ ID NO: 78642 - DNA, 601 bp, Human
catcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcacaattcacacaccaggctgccactttggcccctgcgtcaccttcaccaccacccaatgtgtcctgctcatcactgaggtttgtcatttttactctgagtctgtccattgtcatcatctccaccatcaccccttttgttytcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtct

SEQ ID NO: 78643 - DNA, 601 bp, Human
caattgcacaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtgga

SEQ ID NO: 78644 - DNA, 601 bp, Human
ctgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcagaagagcaaagtccgggtccccaggctcaactatcagccgccttctcatcccaasggctgtcaccaccagaaatttaacatgctgttagtgcatgcaaaaaaaagcccagtaattgtagggctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcagga

SEQ ID NO: 78645 - DNA, 601 bp, Human
agccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcagaagagcaaagtccgggtccccaggctcaactatcagccgccttctcatcccaagggctgtcaccaccagaaatttaacatgctgttagtgcatgcaaaaaaaagcccagtaattgtagsgctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcact

SEQ ID NO: 78646 - DNA, 601 bp, Human
tctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagygctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtgg

SEQ ID NO: 78647 - DNA, 601 bp, Human
gaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttt

SEQ ID NO: 78648 - DNA, 601 bp, Human
ctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcatgtattaatattatgttggtgcaatcacttttgaaccaatctaactaatacttcatccccttgtatggccaaataatattctattctatcaatatattatactttgtttatccattcacagttcatgtcattccca

SEQ ID NO: 78649 - DNA, 601 bp, Human
agattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttc

SEQ ID NO: 78650 - DNA, 601 bp, Human
aaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacagggataatagacaacgctatcaagaggggggccaaccacacatgtgcagccactgtatgacgtctggattttccttgasttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcat

SEQ ID NO: 78651 - DNA, 601 bp, Human
aatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtg

SEQ ID NO: 78652 - DNA, 601 bp, Human
ccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaycctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaa

SEQ ID NO: 78653 - DNA, 601 bp, Human
ccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccatcctggaagttgagtgatggggaataaarggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggc

SEQ ID NO: 78654 - DNA, 601 bp, Human
agatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaa

SEQ ID NO: 78655 - DNA, 601 bp, Human
catctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaataaattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagcygggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccgg

SEQ ID NO: 78656 - DNA, 601 bp, Human
cttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaa

SEQ ID NO: 78657 - DNA, 601 bp, Human
accatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagag

SEQ ID NO: 78658 - DNA, 601 bp, Human
accgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgtt

SEQ ID NO: 78659 - DNA, 601 bp, Human
taaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcat

SEQ ID NO: 78660 - DNA, 601 bp, Human
tcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaa

SEQ ID NO: 78661 - DNA, 601 bp, Human
tcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgkctttaaaaaaaataaattaaatttttaaaaacatgactttctggccaggcgcagtggctcatgcctataaccctgcacttagagagggcaagacagaaggattgcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgt

SEQ ID NO: 78662 - DNA, 601 bp, Human
aaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgtctttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgttta

SEQ ID NO: 78663 - DNA, 601 bp, Human
gacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagt

SEQ ID NO: 78664 - DNA, 601 bp, Human
aaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggtgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagatcacatacatcctgaaaacactgt

SEQ ID NO: 78665 - DNA, 601 bp, Human
tacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagatyacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggc

SEQ ID NO: 78666 - DNA, 601 bp, Human
ttttggtttctctgtctactcattacgtacactctgccagaggttgaaaactcaatgttgagatcacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcc

SEQ ID NO: 78667 - DNA, 601 bp, Human
cgtccctgaatctctaccctgctttatttttctccttagcagacatcatttctctgtttaatctgtctacttgctaattgtctcactgccctccccctccccactggagagtgaatgaaggcttaaggttttgtctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtaca

SEQ ID NO: 78668 - DNA, 601 bp, Human
aagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacat

SEQ ID NO: 78669 - DNA, 601 bp, Human
ctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggcc

SEQ ID NO: 78670 - DNA, 601 bp, Human
tctgcccattagaatctctagggacagaccgaggtttgagagttcctgctcctgatctcaggggaatcctgaattacaggtgttaacctgattatccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactgttattttatttttactaattattttttacacctacaaatcaggatctgctacaa

SEQ ID NO: 78671 - DNA, 601 bp, Human
gtgagactccgctggagagctggttagaaaaacacaagtctcgggccccaccccgcagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtc

SEQ ID NO: 78672 - DNA, 601 bp, Human
tgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggmaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttcta

SEQ ID NO: 78673 - DNA, 601 bp, Human
ggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggaaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttctaagatgtgagatttcaataaatgaatctgtaggctgctgtgatggatacctttggtggggtaggaaggatcgtcatttagaacctgggttctgac

SEQ ID NO: 78674 - DNA, 601 bp, Human
agaagtttgagattggcctgggaaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagca

SEQ ID NO: 78675 - DNA, 601 bp, Human
aatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggc

SEQ ID NO: 78676 - DNA, 601 bp, Human
ggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacaattttggctcgcacatgcttc

SEQ ID NO: 78677 - DNA, 601 bp, Human
ttacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacaattttggctcgcacatgcttcctttttagctcatgaccgtgcaattcaactcaacctcatggcatctttttatcagctgtccctgctgcaacaggcttagagttggtttcccaattcc

SEQ ID NO: 78678 - DNA, 601 bp, Human
agtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggag

SEQ ID NO: 78679 - DNA, 601 bp, Human
gcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgag

SEQ ID NO: 78680 - DNA, 601 bp, Human
aaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctg

SEQ ID NO: 78681 - DNA, 601 bp, Human
ggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcatgaagccacatagtaata

SEQ ID NO: 78682 - DNA, 601 bp, Human
gcagaaactgttttctctggccaggagacaggcttcgttttcgaaactcacccaggaaggcagtgttcttcttttcaaaaggcatttttctgttgactgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgaga

SEQ ID NO: 78683 - DNA, 601 bp, Human
tgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttct

SEQ ID NO: 78684 - DNA, 601 bp, Human
acgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctcyatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggta

SEQ ID NO: 78685 - DNA, 601 bp, Human
gagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagc

SEQ ID NO: 78686 - DNA, 601 bp, Human
aaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggccca

SEQ ID NO: 78687 - DNA, 601 bp, Human
tgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctgg

SEQ ID NO: 78688 - DNA, 601 bp, Human
gtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggc

SEQ ID NO: 78689 - DNA, 601 bp, Human
tatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagt

SEQ ID NO: 78690 - DNA, 601 bp, Human
cttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccac

SEQ ID NO: 78691 - DNA, 601 bp, Human
ggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccacccaaatctcaacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaaga

SEQ ID NO: 78692 - DNA, 601 bp, Human
ctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaa

SEQ ID NO: 78693 - DNA, 601 bp, Human
aacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttac

SEQ ID NO: 78694 - DNA, 601 bp, Human
ctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactgctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagc

SEQ ID NO: 78695 - DNA, 601 bp, Human
tagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcc

SEQ ID NO: 78696 - DNA, 601 bp, Human
ttccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagcaagaaaaaagctaacaatcccatcaaaaagtgggctaaggacatg

SEQ ID NO: 78697 - DNA, 601 bp, Human
agtggttgtactagtttacattcccaccagcagtgtagaagtgttccctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaatacccca

SEQ ID NO: 78698 - DNA, 601 bp, Human
tgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttgkggtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaa

SEQ ID NO: 78699 - DNA, 601 bp, Human
gctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttggrgtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaat

SEQ ID NO: 78700 - DNA, 601 bp, Human
ccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctcatgtgggtggatcg

SEQ ID NO: 78701 - DNA, 601 bp, Human
gaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctgg

SEQ ID NO: 78702 - DNA, 601 bp, Human
aaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactg

SEQ ID NO: 78703 - DNA, 601 bp, Human
gcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcata

SEQ ID NO: 78704 - DNA, 601 bp, Human
gcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatat

SEQ ID NO: 78705 - DNA, 601 bp, Human
acatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgc

SEQ ID NO: 78706 - DNA, 601 bp, Human
taaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaac

SEQ ID NO: 78707 - DNA, 601 bp, Human
tgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcrattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatatt

SEQ ID NO: 78708 - DNA, 601 bp, Human
cctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcamctgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgct

SEQ ID NO: 78709 - DNA, 601 bp, Human
atgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcccagcaaagggcttgtatgcaaaggaccctc

SEQ ID NO: 78710 - DNA, 601 bp, Human
tcatgacaactgccctgaaagttgggtgtacttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatcca

SEQ ID NO: 78711 - DNA, 601 bp, Human
gctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgcta

SEQ ID NO: 78712 - DNA, 601 bp, Human
ccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgc

SEQ ID NO: 78713 - DNA, 601 bp, Human
gagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccagtgctttgacaggctgagggaggagaactgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagc

SEQ ID NO: 78714 - DNA, 601 bp, Human
agtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctg

SEQ ID NO: 78715 - DNA, 601 bp, Human
cggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctt

SEQ ID NO: 78716 - DNA, 601 bp, Human
gactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccag

SEQ ID NO: 78717 - DNA, 601 bp, Human
gtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacgg

SEQ ID NO: 78718 - DNA, 601 bp, Human
agaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttg

SEQ ID NO: 78719 - DNA, 601 bp, Human
tgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggcca

SEQ ID NO: 78720 - DNA, 601 bp, Human
taggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacaga

SEQ ID NO: 78721 - DNA, 601 bp, Human
gtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcc

SEQ ID NO: 78722 - DNA, 601 bp, Human
aggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggrgctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacac

SEQ ID NO: 78723 - DNA, 601 bp, Human
ttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctyttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctg

SEQ ID NO: 78724 - DNA, 601 bp, Human
tattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagta

SEQ ID NO: 78725 - DNA, 601 bp, Human
ccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgc

SEQ ID NO: 78726 - DNA, 601 bp, Human
gagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtca

SEQ ID NO: 78727 - DNA, 601 bp, Human
caagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaa

SEQ ID NO: 78728 - DNA, 601 bp, Human
atatgtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcctccgtcactggctgtgtgaccttaaagaaataaattgacctgcctgagcctctcggaaatattggctggccagtagcatcctcacagagtttttctgggaatcgaatgagagatt

SEQ ID NO: 78729 - DNA, 601 bp, Human
ccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactt

SEQ ID NO: 78730 - DNA, 601 bp, Human
ctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctg

SEQ ID NO: 78731 - DNA, 601 bp, Human
tttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcag

SEQ ID NO: 78732 - DNA, 601 bp, Human
ctttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgt

SEQ ID NO: 78733 - DNA, 601 bp, Human
aggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaata

SEQ ID NO: 78734 - DNA, 601 bp, Human
tggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaa

SEQ ID NO: 78735 - DNA, 601 bp, Human
ggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaac

SEQ ID NO: 78736 - DNA, 601 bp, Human
gacagagcaagattttgtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggrgtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttctttttt

SEQ ID NO: 78737 - DNA, 601 bp, Human
gtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaaygtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttc

SEQ ID NO: 78738 - DNA, 601 bp, Human
tctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacrtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttct

SEQ ID NO: 78739 - DNA, 601 bp, Human
gagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgt

SEQ ID NO: 78740 - DNA, 601 bp, Human
agcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattmcctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttg

SEQ ID NO: 78741 - DNA, 601 bp, Human
tttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcakctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtg

SEQ ID NO: 78742 - DNA, 601 bp, Human
ccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgt

SEQ ID NO: 78743 - DNA, 601 bp, Human
gggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatg

SEQ ID NO: 78744 - DNA, 601 bp, Human
gctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctcct

SEQ ID NO: 78745 - DNA, 601 bp, Human
ggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacartttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgt

SEQ ID NO: 78746 - DNA, 601 bp, Human
caccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatktaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatg

SEQ ID NO: 78747 - DNA, 601 bp, Human
gttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttat

SEQ ID NO: 78748 - DNA, 601 bp, Human
atccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggtttcagtgagctgagatccagcctgggtgacagagcaagactccatctcaaagcraaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaaca

SEQ ID NO: 78749 - DNA, 601 bp, Human
gacagagcaagactccatctcaaagcgaaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcscttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaata

SEQ ID NO: 78750 - DNA, 601 bp, Human
acaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaacwgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataag

SEQ ID NO: 78751 - DNA, 601 bp, Human
aaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctgga

SEQ ID NO: 78752 - DNA, 601 bp, Human
agcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcc

SEQ ID NO: 78753 - DNA, 601 bp, Human
tgtctacactcagctgctaatatgctatgggacctcaggtatgtcacttaaaccttgtgttggagtttcctccttgttacatggaggtcacaagaataacaaactatgcatagatcacctaatttagtcattccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatg

SEQ ID NO: 78754 - DNA, 601 bp, Human
tccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaa

SEQ ID NO: 78755 - DNA, 601 bp, Human
aagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgg

SEQ ID NO: 78756 - DNA, 601 bp, Human
gaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaa

SEQ ID NO: 78757 - DNA, 601 bp, Human
ctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcattccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggata

SEQ ID NO: 78758 - DNA, 601 bp, Human
acttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgcca

SEQ ID NO: 78759 - DNA, 601 bp, Human
atcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaattatttctgtaactcttaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcc

SEQ ID NO: 78760 - DNA, 601 bp, Human
aatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactcccttggttaatttaaataaaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacg

SEQ ID NO: 78761 - DNA, 601 bp, Human
tacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgg

SEQ ID NO: 78762 - DNA, 601 bp, Human
ttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatct

SEQ ID NO: 78763 - DNA, 601 bp, Human
gcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtg

SEQ ID NO: 78764 - DNA, 601 bp, Human
tatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacaggga

SEQ ID NO: 78765 - DNA, 601 bp, Human
cagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagt

SEQ ID NO: 78766 - DNA, 601 bp, Human
taaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactagggrtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgta

SEQ ID NO: 78767 - DNA, 601 bp, Human
attatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtt

SEQ ID NO: 78768 - DNA, 601 bp, Human
cagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatc

SEQ ID NO: 78769 - DNA, 601 bp, Human
atttagagaagaaattagaaaagtaagtgaggcagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcc

SEQ ID NO: 78770 - DNA, 601 bp, Human
taatgtttagcgtttgggggtcactccatagagaggggtttgtggaaatcctttttttttttttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttcccccmccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctca

SEQ ID NO: 78771 - DNA, 601 bp, Human
ccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcat

SEQ ID NO: 78772 - DNA, 601 bp, Human
tcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatg

SEQ ID NO: 78773 - DNA, 601 bp, Human
atgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtgtccaataaatttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagcta

SEQ ID NO: 78774 - DNA, 601 bp, Human
cacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgac

SEQ ID NO: 78775 - DNA, 601 bp, Human
aggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaat

SEQ ID NO: 78776 - DNA, 601 bp, Human
agctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgt

SEQ ID NO: 78777 - DNA, 601 bp, Human
aggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaaca

SEQ ID NO: 78778 - DNA, 601 bp, Human
tcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacattactcaggccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagc

SEQ ID NO: 78779 - DNA, 601 bp, Human
actcaggttctttgattcttaaggtatttttcactgccgagttgctgtcattgaaacaaaatctgtcctggtcaccactgtatgcccagcacgtagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgggtaggacatgtgaaatatttgctcagagagatccagaagtgttgatctgagtaggatcagctggtgctccaggataaaaatcgtgtcaccacttttgccgaaaagtcactgtgtttctcc

SEQ ID NO: 78780 - DNA, 601 bp, Human
aaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcct

SEQ ID NO: 78781 - DNA, 601 bp, Human
ggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccc

SEQ ID NO: 78782 - DNA, 601 bp, Human
gctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatataccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatgtctgttactccatcag

SEQ ID NO: 78783 - DNA, 601 bp, Human
tcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaag

SEQ ID NO: 78784 - DNA, 601 bp, Human
gtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagttagtcg

SEQ ID NO: 78785 - DNA, 601 bp, Human
taacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgttgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagttagtcggggttggtggtgtgctcctgtagttccagctacttgggag

SEQ ID NO: 78786 - DNA, 601 bp, Human
aaataaataaaaagtagttgggcgtgtgttgtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaacccygtctctactaaaaatacaaaagttagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggat

SEQ ID NO: 78787 - DNA, 601 bp, Human
tgtgttgtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagtkagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattgg

SEQ ID NO: 78788 - DNA, 601 bp, Human
taccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatct

SEQ ID NO: 78789 - DNA, 601 bp, Human
tgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagc

SEQ ID NO: 78790 - DNA, 601 bp, Human
aacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcaactcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattggg

SEQ ID NO: 78791 - DNA, 601 bp, Human
tagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctggagtcctgcctctgtgacacttgcttactgtgtgacctgggtcractcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcat

SEQ ID NO: 78792 - DNA, 601 bp, Human
gggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctgga

SEQ ID NO: 78793 - DNA, 601 bp, Human
acagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaagacatttacattttatctttact

SEQ ID NO: 78794 - DNA, 601 bp, Human
ataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacagttagctttatag

SEQ ID NO: 78795 - DNA, 601 bp, Human
aagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatact

SEQ ID NO: 78796 - DNA, 601 bp, Human
actttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacg

SEQ ID NO: 78797 - DNA, 601 bp, Human
gaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcaaaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactcc

SEQ ID NO: 78798 - DNA, 601 bp, Human
tgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatgacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgtta

SEQ ID NO: 78799 - DNA, 601 bp, Human
ccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcrcctaaaattctctcttctacatatctcactgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaa

SEQ ID NO: 78800 - DNA, 601 bp, Human
ctgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcgcctaaaattctctcttctacatatctcastgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaaatccttccacctcagcttgacattacagg

SEQ ID NO: 78801 - DNA, 601 bp, Human
ctccatctatttcaggggatgaccagtctgaataaaaccaatgagcttaatctacttgtggaatgttatagccggaagggattcatagagatcactctatcgcctaaaattctctcttctacatatctcactgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgaactcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtcta

SEQ ID NO: 78802 - DNA, 601 bp, Human
atagagatcactctatcgcctaaaattctctcttctacatatctcactgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgct

SEQ ID NO: 78803 - DNA, 601 bp, Human
tgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgt

SEQ ID NO: 78804 - DNA, 601 bp, Human
tcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggg

SEQ ID NO: 78805 - DNA, 601 bp, Human
gggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacat

SEQ ID NO: 78806 - DNA, 601 bp, Human
ctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagycctcacctggttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacagga

SEQ ID NO: 78807 - DNA, 601 bp, Human
agccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggrgatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaa

SEQ ID NO: 78808 - DNA, 601 bp, Human
ctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggagatccataaagttcttgtcttccccgaytcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaa

SEQ ID NO: 78809 - DNA, 601 bp, Human
ttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaaggagctcagcctctttgttagctagaacaagaaaggggcccgtatggctagcatagg

SEQ ID NO: 78810 - DNA, 601 bp, Human
gagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaaggagctcagcctctttgttagctagaacaagaaaggggcccgtatggctagcataggatgggataggggatcgtggtggataccagctaggatttcactgtaaaagaagaaaggaagccactgaag

SEQ ID NO: 78811 - DNA, 601 bp, Human
cactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaaggagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttgg

SEQ ID NO: 78812 - DNA, 601 bp, Human
aaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatt

SEQ ID NO: 78813 - DNA, 601 bp, Human
cataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctgtccaccactggta

SEQ ID NO: 78814 - DNA, 601 bp, Human
gcctcctaattaccaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgaatattgggccgggcttggtggctcatgcctctaatcc

SEQ ID NO: 78815 - DNA, 601 bp, Human
gtgtttgagatctcagaaatctgcaccccaccttgctgtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaata

SEQ ID NO: 78816 - DNA, 601 bp, Human
tcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgaatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaataaataacattattctcttcattctccaagtaagctgaggcagaggattccagcacaagcaatttggttccaaaacctgcccttttaacctctaccagatt

SEQ ID NO: 78817 - DNA, 601 bp, Human
ccccactttatccaaaagttattcagtgttttacaaagacatgaatattgggccgggcttggtggctcatgcctctaatcctacctgaagcaagagaatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcacaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcct

SEQ ID NO: 78818 - DNA, 601 bp, Human
aatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctg

SEQ ID NO: 78819 - DNA, 601 bp, Human
cactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggaggaaaaatcatccaaactacttggtaattgaattcaagagtgatggaccaaaaattattaatgcattcccttccgtccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtat

SEQ ID NO: 78820 - DNA, 601 bp, Human
tcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctggggcaacgctaccaacattggtattccacagcattccaacgattctaaatactctcccagagtagggmggaaaaatcatccaaactacttggtaattgaattcaagagtgatggaccaaaaattattaatgcattcccttccgtccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgca

SEQ ID NO: 78821 - DNA, 601 bp, Human
ctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctggggcaacgctaccaacattggtattccacagcattccaacgattctaaatactctcccagagtagggaggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatga

SEQ ID NO: 78822 - DNA, 601 bp, Human
atttataatggctgcctgataattggagatacatgcaccagacttgacttaactgttctcttagtcatcagacatttagatttcaacatgctcctgttaagctctccttacagtgtgtgtggcactgtgcagttgaatgaaacatgccatggccagtggaaacaggcttgggctgatggagagggcctacagggccaggccttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttctgaataaaagtatgatgatgatgatcatggtgatgaagatgagggtgatgatgttgatgatgatgatggtgatggtgatgatggtagtatgataatgctg

SEQ ID NO: 78823 - DNA, 601 bp, Human
cttgaaggggagggaaattgttagctacacgaccaagagacagaagagaggaaggagtttgtacccacaactcagctttattttatgtaagctctttctgtaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgat

SEQ ID NO: 78824 - DNA, 601 bp, Human
gcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaacaaattattttatctctctgagctcagtctcctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtg

SEQ ID NO: 78825 - DNA, 601 bp, Human
aaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccaggagccctcaggccgctggtgagtgaagttcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaccttcataataaggactcacatgtgtcggtcccaaggatccccaagggatactcatggttga

SEQ ID NO: 78826 - DNA, 601 bp, Human
acagtctctggagctaggcttgtgactttgaacaaattattttatctctctgagctcagtctcctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttacagccaaggagaagttaaattctaaagacttgggcagtctccagggaata

SEQ ID NO: 78827 - DNA, 601 bp, Human
acacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgkataatggttttaaaataccaaaaaatatttcttcaatttttttctgctactcataatgtagcatctgtagagcgacacacttttgaatttgagttaatatttcctttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggc

SEQ ID NO: 78828 - DNA, 601 bp, Human
tattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgtataatggttttaaaatacyaaaaaatatttcttcaatttttttctgctactcataatgtagcatctgtagagcgacacacttttgaatttgagttaatatttcctttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggc

SEQ ID NO: 78829 - DNA, 601 bp, Human
gatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgacctccggtgatctgcctgtctccgcctcccaaagtgctgggattacaggcgtgagccaccgcg

SEQ ID NO: 78830 - DNA, 601 bp, Human
ctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtcaatgacttcaagagcataggtaacagtaaaatgtagtaaaasaatttagaagtcatgagttttgagtacttagtactttttagtatgatttatttaatagtaaccttatataatgtttttcttttaattgttttattgagatgtatttcatacactttccaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaaga

SEQ ID NO: 78831 - DNA, 601 bp, Human
cctggatttgtagcgaatgtctatttccatggtgtaaatagtggtaccctgagcaattttaagttataaatatgagatcactgaaagtggagttggggaacacgttattatatagtattttcaccacacacaggatacagtcaatgacttcaagagcataggtaacagtaaaatgtagtaaaacaatttagaagtcatgagttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctggg

SEQ ID NO: 78832 - DNA, 601 bp, Human
ggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgcttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcata

SEQ ID NO: 78833 - DNA, 601 bp, Human
aaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatagatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgtt

SEQ ID NO: 78834 - DNA, 601 bp, Human
tactctttttatagtgtcttttgatgaacaaagattttaaatcttgatgaagtccactttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcgtgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcccataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatc

SEQ ID NO: 78835 - DNA, 601 bp, Human
tgttgtatctaagaatccattgccaaatccaaggacataaacatttactcctgtggtgttatgatatatatagggttcctggctcataactctcatagcccttgttgcagtctattgttacaatattgcgtgtgttaggcatcaggaaacagaatctctttgtctcctgtccttctttcacctgccccaaggcaggactctaatctttcccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatctgctccagcaaattaatcaaacccaaagagggggttatgggaacttccacctgaagcccctcagccagacattctgaagtctctgacttgcta

SEQ ID NO: 78836 - DNA, 601 bp, Human
ttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacactgttttggttac

SEQ ID NO: 78837 - DNA, 601 bp, Human
ggtttcagaaaagagtttttccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctrtccttatgccattgccacactgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccct

SEQ ID NO: 78838 - DNA, 601 bp, Human
ccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacaytgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatatt

SEQ ID NO: 78839 - DNA, 601 bp, Human
ttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttygttaattcctgtgaccatatggcagcatggttaggatcttgggcttctaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaa

SEQ ID NO: 78840 - DNA, 601 bp, Human
tctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttcgttaattcctgtgaccatatggcagcatggttaggatcttgggcttcyaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctg

SEQ ID NO: 78841 - DNA, 601 bp, Human
cgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaaga

SEQ ID NO: 78842 - DNA, 601 bp, Human
acagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagc

SEQ ID NO: 78843 - DNA, 601 bp, Human
aagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcacacccaaaccttgataaccatggcaatgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcac

SEQ ID NO: 78844 - DNA, 601 bp, Human
tttagcagtaacagaatccacactagaaggacagagtgctgtacagacagaaggaaagacgcacacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattt

SEQ ID NO: 78845 - DNA, 601 bp, Human
gctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaac

SEQ ID NO: 78846 - DNA, 601 bp, Human
atcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatccarttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaactcatccttgcagtgggataaacattgcctagaagggtttgaagaggaatcc

SEQ ID NO: 78847 - DNA, 601 bp, Human
caggcgtgagtcaccatgccaggcccctgcctctgtttaaatgctcaaacttggtatggaactgcacagactatacggctgctctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatata

SEQ ID NO: 78848 - DNA, 601 bp, Human
ccttgcttcttccaccatgtgagaaaacagcaagaagaatatccatgaatctatgaggaggcgggactctggccagacattgaatttgctgcttccttgatcttggacttcccagcttccagaaccatgagcaataaatttctttttttcaaagctccccaggagtctctctcggtctgttctggctcaggaagctgccttatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaccttggtaagttatagctgttgctgtcattcctgcagctgttatctttgtcattacgcttactgttattattagctctgctatcagagtgatgctgtggctggagaagatggagacccatgtgtt

SEQ ID NO: 78849 - DNA, 601 bp, Human
ctgttctggctcaggaagctgccttatttgtaacaaacaaataaacaaaaaacaaaataaataaaagctacccagcttagattattttgtcataaaagccccaaaagactatgacaaatccttctatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgtagacacagggcacagaactgccaactgtggctgctgacacctgtctgactttgactgggttagtgacaaagaaatgactttccttttgtatgttagccctgtgcctggcatactgcaaatatctatggttgat

SEQ ID NO: 78850 - DNA, 601 bp, Human
aactaaagtaccatcttcatgtggtcagcacaatggctgacacatagcaagaccttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgtagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagtaatgggagttggaggcttaacactgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaag

SEQ ID NO: 78851 - DNA, 601 bp, Human
aaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggttaagagaatggctctgaatgtctacctagctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggag

SEQ ID NO: 78852 - DNA, 601 bp, Human
aattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctctggctggtcagtaagaacctttgatcccatgtttcttt

SEQ ID NO: 78853 - DNA, 601 bp, Human
gaaatgtagtctggtgatgcctcgaggaggcaagagaaatgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagc

SEQ ID NO: 78854 - DNA, 601 bp, Human
aggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaatcccaacactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtga

SEQ ID NO: 78855 - DNA, 601 bp, Human
aatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattcgtccagtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgattcgtggtcacaccactgccctcaaccctgggtgacagggtgagaccctgtctctaaaaacaaaagcaaagtctactaaaaattcactggagctatgagaaatctt

SEQ ID NO: 78856 - DNA, 601 bp, Human
ggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttgtttttttttttttaagagatttacagt

SEQ ID NO: 78857 - DNA, 601 bp, Human
tcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgctgtctctttaacggagagttcatgggcwgggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagattttcttatgaaactgattttactcaccagggatagagtctcaaagttggaggtattttatgttgttttaaataatatcgtcatcacatgtcattttagaccccaaaagtccactccgaatctctgcttatggaattgaggaggggtgagg

SEQ ID NO: 78858 - DNA, 601 bp, Human
tcctggcatttgtgtcttatgcaaggctattatgtgaagttaggaaatatttaaaactctgcctttctaaagaaacagggacacggtgcagaaaagttcatctggagttaggcttgtgtcttgctgtctctttaacggagagttcatgggcagggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagrttttcttatgaaactgattttactcaccagggatagagtctcaaagttggaggtattttatgttgttttaaataatatcgtcatcacatgtcattttagaccccaaaagtccactccgaatctctgcttatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctcta

SEQ ID NO: 78859 - DNA, 601 bp, Human
ccccaaaagtccactccgaatctctgcttatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggacatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcac

SEQ ID NO: 78860 - DNA, 601 bp, Human
ccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcataattagcctgcaaacgtgaatta

SEQ ID NO: 78861 - DNA, 601 bp, Human
attgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattgtctaaaatcccaaatgcattcttagctaaggtcagtgtgtctgggtctgtgtcaggcatgtagcagccacagcaaacttctcttgagatagcatctcctccccagcac

SEQ ID NO: 78862 - DNA, 601 bp, Human
gcctgtagtcactggctatgaaaatggccccaaataaagtggtatccacacttcttctttctcctacgaatttggaggtctaggaacgggggtaagcctatatggtcataattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggca

SEQ ID NO: 78863 - DNA, 601 bp, Human
gcaaagattcaactgaaaacattttagggggttcctgacttcaggcctcttttcagaatgagggaattgtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacaccactcaccatttttgtggtgggcatggtggctcatgcctgtaatcccagc

SEQ ID NO: 78864 - DNA, 601 bp, Human
taaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaa

SEQ ID NO: 78865 - DNA, 601 bp, Human
acctctttcaatgttttttcagcaaaatggggtaagaacagaatctgccttgcagagaattaaccgagatgatgtgtggaaagggcctatcccagaggctggtgtaccatggtggcttctcctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatggaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaa

SEQ ID NO: 78866 - DNA, 601 bp, Human
attattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactt

SEQ ID NO: 78867 - DNA, 601 bp, Human
aagcaatcctcctgcctcagcctcccaagtagcttagaaccacaggcatataccaccatacctggacatgtttttaactttaatttttatttttgtagagatgaggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatrgtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgct

SEQ ID NO: 78868 - DNA, 601 bp, Human
ctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatga

SEQ ID NO: 78869 - DNA, 601 bp, Human
cagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaacagattaacaacatctcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaa

SEQ ID NO: 78870 - DNA, 601 bp, Human
atgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttattgtgtcctaatctatgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgcc

SEQ ID NO: 78871 - DNA, 601 bp, Human
acatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaacccaggaacaactactgtatggccacttcaaacctgtatatgctgcaagtattttatactaggtagggtaaataataggtcttagatataggtgcaaataattttcaaatatgggtaaatgctattgggatgtgtaaagtagaaatccattttaaagcgttattgaatccatactaacctgatcattacatatttactaattg

SEQ ID NO: 78872 - DNA, 601 bp, Human
cggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacatgcagccacacttgtt

SEQ ID NO: 78873 - DNA, 601 bp, Human
gctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtrtattattctgcaattgctgagtaattgatgatccttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgta

SEQ ID NO: 78874 - DNA, 601 bp, Human
accgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtatattattctgcaattgctgagtaattgatgatcsttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggcc

SEQ ID NO: 78875 - DNA, 601 bp, Human
acctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattt

SEQ ID NO: 78876 - DNA, 601 bp, Human
taaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttaggtcataagtatttttcatttaattttttttccccttaatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttg

SEQ ID NO: 78877 - DNA, 601 bp, Human
ttttttttccccttaatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctcctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttag

SEQ ID NO: 78878 - DNA, 601 bp, Human
gctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcaggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatc

SEQ ID NO: 78879 - DNA, 601 bp, Human
ttaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctcta

SEQ ID NO: 78880 - DNA, 601 bp, Human
atgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatcttta

SEQ ID NO: 78881 - DNA, 601 bp, Human
tatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgcagtccagcaagggtctcagtcaacctt

SEQ ID NO: 78882 - DNA, 601 bp, Human
ggacctcttcgggtcccagccctttctgttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcacc

SEQ ID NO: 78883 - DNA, 601 bp, Human
cctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggcmttagtttcgtcttttctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcag

SEQ ID NO: 78884 - DNA, 601 bp, Human
cttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggccttagtttcgtctttyctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcag

SEQ ID NO: 78885 - DNA, 601 bp, Human
gctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttsgtgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctac

SEQ ID NO: 78886 - DNA, 601 bp, Human
ctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttgstgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctact

SEQ ID NO: 78887 - DNA, 601 bp, Human
gtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaact

SEQ ID NO: 78888 - DNA, 601 bp, Human
gtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatt

SEQ ID NO: 78889 - DNA, 601 bp, Human
ataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaat

SEQ ID NO: 78890 - DNA, 601 bp, Human
ttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggtaggtgcttcctaaagcagaaaaatgtaagggaagtcatcatcgctta

SEQ ID NO: 78891 - DNA, 601 bp, Human
caaattaaatcttaaattgagcttgtggttctgtgaattaatactccagcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctga

SEQ ID NO: 78892 - DNA, 601 bp, Human
ataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatataattcaagttgagatttgggtggagacacacccaaagcatatcagggtcctaggcaactttgtgtgagaaca

SEQ ID NO: 78893 - DNA, 601 bp, Human
tgtttttcacgctgctgataaagacacacccgagactgggaagaaaaagaggtttaattggacttacagttctgcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccg

SEQ ID NO: 78894 - DNA, 601 bp, Human
tttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaaagccgaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagag

SEQ ID NO: 78895 - DNA, 601 bp, Human
aaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatataagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatgg

SEQ ID NO: 78896 - DNA, 601 bp, Human
ggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccacgttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagt

SEQ ID NO: 78897 - DNA, 601 bp, Human
aacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctaggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacattta

SEQ ID NO: 78898 - DNA, 601 bp, Human
ctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaa

SEQ ID NO: 78899 - DNA, 601 bp, Human
ttacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaag

SEQ ID NO: 78900 - DNA, 601 bp, Human
tttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttg

SEQ ID NO: 78901 - DNA, 601 bp, Human
aagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgc

SEQ ID NO: 78902 - DNA, 601 bp, Human
gtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccscatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacat

SEQ ID NO: 78903 - DNA, 601 bp, Human
cacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaawaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgtt

SEQ ID NO: 78904 - DNA, 601 bp, Human
gtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtca

SEQ ID NO: 78905 - DNA, 601 bp, Human
ctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccc

SEQ ID NO: 78906 - DNA, 601 bp, Human
gggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagtt

SEQ ID NO: 78907 - DNA, 601 bp, Human
taaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctatyggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgta

SEQ ID NO: 78908 - DNA, 601 bp, Human
gcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctattggacacatgtcctaataataaacgtgatatmatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaa

SEQ ID NO: 78909 - DNA, 601 bp, Human
cagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcytccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttggg

SEQ ID NO: 78910 - DNA, 601 bp, Human
tcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcctccccaacctaaggaaactgagacccagagrttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcag

SEQ ID NO: 78911 - DNA, 601 bp, Human
tatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagg

SEQ ID NO: 78912 - DNA, 601 bp, Human
agtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttgctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggc

SEQ ID NO: 78913 - DNA, 601 bp, Human
tgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgc

SEQ ID NO: 78914 - DNA, 601 bp, Human
attacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggccc

SEQ ID NO: 78915 - DNA, 601 bp, Human
aagttctttgaggccaaggactgtgtcttattctgtgttgcatccctttggcttcagcctcattgtcttgagtttattaagcatttggaacatttcagctgaatgagtgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcgtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcc

SEQ ID NO: 78916 - DNA, 601 bp, Human
tcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagc

SEQ ID NO: 78917 - DNA, 601 bp, Human
gttcacaaacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaacaacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtata

SEQ ID NO: 78918 - DNA, 601 bp, Human
acgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctc

SEQ ID NO: 78919 - DNA, 601 bp, Human
caaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcct

SEQ ID NO: 78920 - DNA, 601 bp, Human
aaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcctgcactgcaccaggccttgccaatacagtacctcatttaattcttgctaccatccttgaggt

SEQ ID NO: 78921 - DNA, 601 bp, Human
tcttcctttgcacagactaatagcacactgaggtaggatccagggacggctccttggcaagttgtactgctgtggcctagggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaatacagtacctcatttaattcttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcc

SEQ ID NO: 78922 - DNA, 601 bp, Human
tatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttgg

SEQ ID NO: 78923 - DNA, 601 bp, Human
ggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcagagaaagcttgaatgagtaaatttactttgtgttgttccaaaggtttctccaaaggtctttgcacctccc

SEQ ID NO: 78924 - DNA, 601 bp, Human
ttggtgaaccaaatattttgtatcttataccaagaaagaggggctgacaaagattgagtgattagaaatccaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggt

SEQ ID NO: 78925 - DNA, 601 bp, Human
ttccagaccagcctgaccaatatagtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatwtaaaacagcaactggaggatcctggtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctc

SEQ ID NO: 78926 - DNA, 601 bp, Human
tgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatataaaacagcaactggaggatcctgrtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctc

SEQ ID NO: 78927 - DNA, 601 bp, Human
tgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtct

SEQ ID NO: 78928 - DNA, 601 bp, Human
tcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatckactctagtagttgctccaaatgtgatgtcctcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagc

SEQ ID NO: 78929 - DNA, 601 bp, Human
tcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatctactctagtagttgctccaaatgtgatgtcstcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagcaaacatctagacgtagttctcaatagtagg

SEQ ID NO: 78930 - DNA, 601 bp, Human
tggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatctactctagtagttgctccaaatgtgatgtcctcataaatcaccgagggatcttgttaaatttggaytctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagcaaacatctagacgtagttctcaatagtaggactattgccagtggagggggcattttggaaatttg

SEQ ID NO: 78931 - DNA, 601 bp, Human
gagccagtggtttattttgcattgtttatgtcagcattaagcagtattcttacacagtttgtaagtcttaaaactcagtatctactctagtagttgctccaaatgtgatgtcctcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatttttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataagaaagaactgccctcgtcccggtaacatacacctgtgcccccagacattcatttcggtaaaaaacttgttt

SEQ ID NO: 78932 - DNA, 601 bp, Human
tatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgat

SEQ ID NO: 78933 - DNA, 601 bp, Human
aacatctagacgtagttctcaatagtaggactattgccagtggagggggcattttggaaatttggaaaggcattttggtggcctttggcacttagcaggtggggtccacgggtccatcctgtgatgccataggcagtccaatataagaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctac

SEQ ID NO: 78934 - DNA, 601 bp, Human
caggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaa

SEQ ID NO: 78935 - DNA, 601 bp, Human
ttcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttatacaatatttcttttgaaacgagggtctcgattattgggcttgagtatcctgatctaatta

SEQ ID NO: 78936 - DNA, 601 bp, Human
actaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttatacaatatttcttttgaaacgagggtctcgattattgggcttgagtatcctgatctaattaatgcactggacagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttt

SEQ ID NO: 78937 - DNA, 601 bp, Human
tatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttayacaatatttcttttgaaacgagggtctcgattattgggcttgagtatcctgatctaattaatgcactggacagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcag

SEQ ID NO: 78938 - DNA, 601 bp, Human
gtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttatacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctc

SEQ ID NO: 78939 - DNA, 601 bp, Human
agctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggat

SEQ ID NO: 78940 - DNA, 601 bp, Human
ggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggat

SEQ ID NO: 78941 - DNA, 601 bp, Human
ggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcccttttagaagctgaggcaggaggattgcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacat

SEQ ID NO: 78942 - DNA, 601 bp, Human
aaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaa

SEQ ID NO: 78943 - DNA, 601 bp, Human
gctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctg

SEQ ID NO: 78944 - DNA, 601 bp, Human
aaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacatccagggaaacatagtgtgaccccatttctacaagaagtaaaaaaaatcatctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttgg

SEQ ID NO: 78945 - DNA, 601 bp, Human
gatggattgctggagctcaggagtttgagaacatccagggaaacatagtgtgaccccatttctacaagaagtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaakaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaat

SEQ ID NO: 78946 - DNA, 601 bp, Human
ccagggaaacatagtgtgaccccatttctacaagaagtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacagrcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaa

SEQ ID NO: 78947 - DNA, 601 bp, Human
gtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattctta

SEQ ID NO: 78948 - DNA, 601 bp, Human
tggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgcaacaaacccacaaatgaaatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgt

SEQ ID NO: 78949 - DNA, 601 bp, Human
cccggccagagttggctggggcacagtctaacagtgtcaccgtgtaagctgacccagtgaccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatga

SEQ ID NO: 78950 - DNA, 601 bp, Human
ccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcctatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaa

SEQ ID NO: 78951 - DNA, 601 bp, Human
gtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcgtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagc

SEQ ID NO: 78952 - DNA, 601 bp, Human
tccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgcctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactga

SEQ ID NO: 78953 - DNA, 601 bp, Human
gaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggctttggcccataggaggtctttcgggcaggttcctgcacccttttgacatgccccg

SEQ ID NO: 78954 - DNA, 601 bp, Human
tttttcctttgtaattaataaatatattgggggaggtactttgggactacttctctaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacata

SEQ ID NO: 78955 - DNA, 601 bp, Human
agcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgg

SEQ ID NO: 78956 - DNA, 601 bp, Human
ctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagt

SEQ ID NO: 78957 - DNA, 601 bp, Human
acaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgag

SEQ ID NO: 78958 - DNA, 601 bp, Human
tggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgagccgaaaaatctatttagcccagtttttatccttgcagataagttagtacgcttctttttctgctggttgtgatcatatttctatttaggggtaaaggtgctgaaaatcatttgc

SEQ ID NO: 78959 - DNA, 601 bp, Human
gggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgt

SEQ ID NO: 78960 - DNA, 601 bp, Human
ttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagc

SEQ ID NO: 78961 - DNA, 601 bp, Human
gccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaaraaagaaaacaaccacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaaca

SEQ ID NO: 78962 - DNA, 601 bp, Human
gctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaagaaagaaaacaacyacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctg

SEQ ID NO: 78963 - DNA, 601 bp, Human
agctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcataaactcttcaataactgggaatttataccgtttatagtttttttactgctaagaataatgttgcaatgaaacgtttgtatataatgctg

SEQ ID NO: 78964 - DNA, 601 bp, Human
atgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgaggg

SEQ ID NO: 78965 - DNA, 601 bp, Human
ttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctactctgaacaggattgtcctgtgtaacctacagggggaagtgatagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacag

SEQ ID NO: 78966 - DNA, 601 bp, Human
cttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtctagagaaagggagatgagcttctgtggtagccagaggtcaagatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgct

SEQ ID NO: 78967 - DNA, 601 bp, Human
cgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaactgcaatttatatcttgcccccacccagtgttgatttgcccggggtcatacagataattagtaatgtcttatctc

SEQ ID NO: 78968 - DNA, 601 bp, Human
gatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaacwgcaatttatatcttgcccccacccagtgttgatttgcccggggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccag

SEQ ID NO: 78969 - DNA, 601 bp, Human
tacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaactgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctct

SEQ ID NO: 78970 - DNA, 601 bp, Human
ggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataata

SEQ ID NO: 78971 - DNA, 601 bp, Human
tgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgttcttacaagtgtgtttaaatctctttctgttaatttacaatttgaaaggtgggtgaggagaagagt

SEQ ID NO: 78972 - DNA, 601 bp, Human
ccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgttcttacaagtgtgtttaaatctctttctgttaatttacaatttgaaaggtgggtgaggagaagagtttgaaaaatagattactgtcttcattaatacaggtttgacctacaaagt

SEQ ID NO: 78973 - DNA, 601 bp, Human
gttgaacccccgacctcaggtgatctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattatwacctttgttcttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacact

SEQ ID NO: 78974 - DNA, 601 bp, Human
cgacctcaggtgatctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgttyttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaa

SEQ ID NO: 78975 - DNA, 601 bp, Human
tatgagtatccagggaggatgtttctggcagagggatcagcataggaaaggagttcagggatgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcccttgaacccaggaggcagagattgcagtgagcccagatcatgccactgcactccagcgtgggtgacagagcaagactctgtctcagaaagaggaaagaaatggaatagatctctttcag

SEQ ID NO: 78976 - DNA, 601 bp, Human
taaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcccttgaacccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagag

SEQ ID NO: 78977 - DNA, 601 bp, Human
aggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcycttgaacccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtca

SEQ ID NO: 78978 - DNA, 601 bp, Human
ggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcccttgarcccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgc

SEQ ID NO: 78979 - DNA, 601 bp, Human
tttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtggatgtatatatatgtgtgtgtatgtatatatatgtatgtatctgtatatgtataatggctgtacatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttcttt

SEQ ID NO: 78980 - DNA, 601 bp, Human
cctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtgtatgtatatatatgtgtgtgtatgtatatatatgtatgtatctgtatatgtataatggctgkacatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtc

SEQ ID NO: 78981 - DNA, 601 bp, Human
ctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtgtatgtatatatatgtgtgtgtatgtatatatatgtatgtatctgtatatgtataatggctgtmcatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtct

SEQ ID NO: 78982 - DNA, 601 bp, Human
actgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctct

SEQ ID NO: 78983 - DNA, 601 bp, Human
ctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaycaatggaccactggtccctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatca

SEQ ID NO: 78984 - DNA, 601 bp, Human
acccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaccaatggaccactggtcyctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttgg

SEQ ID NO: 78985 - DNA, 601 bp, Human
ggaccctgagtatcttagaatcttctgaaataatatgcagcattatattccatttgtacctgggaagagggtacttgtctttcatcagagagtcaccaatggaccactggtccctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctattgtacaatatatggtcttttgtgattggcctcctccacttagcgtcgtgtttttgaggttcagccacagttgtagcatgtccatctctctttgtgtggctgaatatcattgcattgtatggatataccaaatatttttctcct

SEQ ID NO: 78986 - DNA, 601 bp, Human
tgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctrttgtacaatatatggtcttttgtgattggcctcctccacttagcgtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccaccta

SEQ ID NO: 78987 - DNA, 601 bp, Human
tgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctattgtacaatatatggtcttttgtgattggcctcctccacttagcrtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaat

SEQ ID NO: 78988 - DNA, 601 bp, Human
tatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagacagaatcttgctctgttgcccaggctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttgg

SEQ ID NO: 78989 - DNA, 601 bp, Human
ttccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctctttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaagaataa

SEQ ID NO: 78990 - DNA, 601 bp, Human
gaattgtgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttggttttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtat

SEQ ID NO: 78991 - DNA, 601 bp, Human
ggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaagaataaacaagaattgtgtctggcctttgtgatagttactcaacaaatcatatctgtgattgttttgrttttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagttt

SEQ ID NO: 78992 - DNA, 601 bp, Human
taaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaagaataaacaagaattgtgtctggcctttgtgatagttactcaacaaatcatatctgtgattgttttggttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcattt

SEQ ID NO: 78993 - DNA, 601 bp, Human
tagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctgtttggctcc

SEQ ID NO: 78994 - DNA, 601 bp, Human
ttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgtggaactaatttttatactgccaatctgaggccttttctgacctcatcgctgccactgtaaaatgaattctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctc

SEQ ID NO: 78995 - DNA, 601 bp, Human
ctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtgagtttcttaaagtcctacaactggtgagctgtgagctgtaaattgyggaactaatttttatactgccaatctgaggccttttctgacctcatcgctgccactgtaaaatgaattctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgctta

SEQ ID NO: 78996 - DNA, 601 bp, Human
aaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactatcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaacgttggaaccaatgctgatg

SEQ ID NO: 78997 - DNA, 601 bp, Human
caattttggggggtcaagaaaatgttctaggacaagactgtggtgatggctgcacaactggataaatatactaactatcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtca

SEQ ID NO: 78998 - DNA, 601 bp, Human
tccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcccccagatagcctcttagcagagycaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtc

SEQ ID NO: 78999 - DNA, 601 bp, Human
tatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagsgggaaattgctttccatctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaggaatcataagtttttcaaactttagaatcacaaggtccattaaaggacatctcccctgaccttcccattttgtagatgggaagactaaggtccaagcttgaatgacctgccatcatggggataaccg

SEQ ID NO: 79000 - DNA, 601 bp, Human
atgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccrtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaggaatcataagtttttcaaactttagaatcacaaggtccattaaaggacatctcccctgaccttcccattttgtagatgggaagactaaggtccaagcttgaatgacctgccatcatggggataaccggaattgatacaatgtc

SEQ ID NO: 79001 - DNA, 601 bp, Human
cagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccatctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctcactgatcttttaaatatgtaattcttcctcctcttctccccttgtctctcttctcacccctaccaatgtaatcagttctttttttcttttttgga

SEQ ID NO: 79002 - DNA, 601 bp, Human
cttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattrtaggcatgagccaccatgcccggcctaatctaatcaattcctttaaatctgaaactgtccgcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttt

SEQ ID NO: 79003 - DNA, 601 bp, Human
ctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattataggcatgagccaccatgcccggcctaatctaatcaattcctttaaatctgaaactgtcygcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacaga

SEQ ID NO: 79004 - DNA, 601 bp, Human
tgaataaccatgtcacagtggcaggagagggactgggtgaacttgagtctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgg

SEQ ID NO: 79005 - DNA, 601 bp, Human
aactcctggcctcaagtgatccgcccaccttggcctcccaaagcgctgggattacaggtgtgagcccccaggccctaccctgggcccctcctttctggcccctcaacctattttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggawttataaaggaattctggttataattgcatgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagt

SEQ ID NO: 79006 - DNA, 601 bp, Human
ctcctgctttggcctcctgaagtactgagattacgggtgtaagtcaccacacccagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaa

SEQ ID NO: 79007 - DNA, 601 bp, Human
tgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctrgatatttcaactagtttacatgactttcttacctatgctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagac

SEQ ID NO: 79008 - DNA, 601 bp, Human
tcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctggatatttcaactagtttacatgactttcttacctaygctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgtt

SEQ ID NO: 79009 - DNA, 601 bp, Human
gttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgttaatcaacaaatagattgtgaatgcttgactcttctctttttttttttttaaaggagtttcaagggtaagatctgctgtcttgtgaatgtcaaagaagtttctcattcgcccctttcttctctctcccagtgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaa

SEQ ID NO: 79010 - DNA, 601 bp, Human
aaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgcctta

SEQ ID NO: 79011 - DNA, 601 bp, Human
attttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccastgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttcta

SEQ ID NO: 79012 - DNA, 601 bp, Human
tttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcttcacagtaggacaccaaaccctctgtatgccctgcctgcctccccccctctgacccgcctgcctccccsctgtgagctttttccacctactggcctcttgttcttcttcagctgttcctcagacatgccaggtgtgttcctgtctcagacgctttgcctttgctgctccttctgcctggagtattcttccacgtagcaccatgagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagaca

SEQ ID NO: 79013 - DNA, 601 bp, Human
ttaatttagtcagacgaggaaggaaacgagaaaagttattcctatttcatccatctaagactttatatcccatttcaggctgattaaaaggcaaaatcttcacagtaggacaccaaaccctctgtatgccctgcctgcctccccccctctgacccgcctgcctcccccctgtgagctttttccacctactggcctcttgttcttcttcagctgttcctcagacatgccaggtgtgttcctgtctcagacgctttgcctttgctgctccttctgcctggagtattcttccacgtagcaccaygagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctaga

SEQ ID NO: 79014 - DNA, 601 bp, Human
atacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatgggaatcctgagccacaactccttagcctcatgac

SEQ ID NO: 79015 - DNA, 601 bp, Human
cttggatgtataatgtccaactcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctsagtaagtatccactggggttcggaatacaactgccctgcctcttgagcagccatgcctgcttccgaggtggtgctgcatgctattcaggaggacagaccatggatgggaatcctgagccacaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaac

SEQ ID NO: 79016 - DNA, 601 bp, Human
tcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttsggaatacaactgccctgcctcttgagcagccatgcctgcttccgaggtggtgctgcatgctattcaggaggacagaccatggatgggaatcctgagccacaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctc

SEQ ID NO: 79017 - DNA, 601 bp, Human
gcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgmatgctattcaggaggacagaccatggatgggaatcctgagccacaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggct

SEQ ID NO: 79018 - DNA, 601 bp, Human
ggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatgggaatcctgagccasaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggttt

SEQ ID NO: 79019 - DNA, 601 bp, Human
tacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatgggaatcctgagccacaactccttagcctcatgacgttgggcagatgactgagcttgtctgagttacaataaayaaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctat

SEQ ID NO: 79020 - DNA, 601 bp, Human
atgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaagcaaattaacttctgtaatcctaagtacttgttaaggcagaaaaacgcagataagaaaatcgaagttgagggcaaggagctcatctttcacggtcatagacctcagttgcaacatct

SEQ ID NO: 79021 - DNA, 601 bp, Human
aacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaagcaaattaacttctgtaatcctaagtacttgttaaggcagaaaaacgcagataagaaaatcgaagttgagggcaaggagctcatctttcacggtcatagacctcagttgcaacatctggaaaa

SEQ ID NO: 79022 - DNA, 601 bp, Human
aaactcaagaagctgaggcaggagaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagaggaagtgaagattgcatctcagtatgagacaccgtaagagcttgataaatggtggaccctctgatgttgacaacatgatgtcaaagatggtgtttgctgttgtttcaaatgtcttatttcaaattcccaatta

SEQ ID NO: 79023 - DNA, 601 bp, Human
ccataaggacaaaatccacatctcatactttttcaggatctgctctcacttccccaaacatgtaataccaccctggtcttcaagtccactctcaaaaaaaaaaaaaaatttggcctttggcctcgtgaccaccaaatctgatttccatccaagaggcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgacca

SEQ ID NO: 79024 - DNA, 601 bp, Human
aattcctggctgggcatgatggttcacgcctgtaatcccagcgctttgggaggccgaggcaggcggatcacctaaggtcgggagttcgagaccagtctgatcaacatggagaaaccctgtctttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttacatttgtgaataagaaaactggggtctatttggtggtttatttcagagatgttggatcaaatcagacatcagaaaagacaccagtac

SEQ ID NO: 79025 - DNA, 601 bp, Human
ggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacaccagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcg

SEQ ID NO: 79026 - DNA, 601 bp, Human
cgccctgttgccaggctggagtgtggtggcaggatcacggctcactgcaacctttgcctcctgggcgcaagtgatcctcctacctcagcctcccaagggagctgggaccacaggggcacaccaccatgcctgcctaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaatattcaacaaacaatttcggagggccaactatttgccaggatccttgctggaatagtctctaacctcaaggcaattgctgtctagctttaagatcaagagtaattgtgacttgatgtaaggtatctgtgttg

SEQ ID NO: 79027 - DNA, 601 bp, Human
gattttgccatgttgcccaggctggtctcaaaactcctgggctcaagcgattcacgtgcctcagcctcccaaagtgctagggttacaggcatgagccactgtgcctggccctggtaaaattttgtctacatagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtg

SEQ ID NO: 79028 - DNA, 601 bp, Human
gtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggacaggaagcaccttagcggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttc

SEQ ID NO: 79029 - DNA, 601 bp, Human
gggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcgatgtcgtaggctgagggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaa

SEQ ID NO: 79030 - DNA, 601 bp, Human
atcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctg

SEQ ID NO: 79031 - DNA, 601 bp, Human
atcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactttatttactcaatattaattatatgagaaataaatcctaaatgtaattttgaatggtggcttcacaaaagaacatttcctcttcttttggacatttgctcccaattttaaataacacatcattgaacatctctgtacaaaa

SEQ ID NO: 79032 - DNA, 601 bp, Human
ctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgct

SEQ ID NO: 79033 - DNA, 601 bp, Human
tgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatat

SEQ ID NO: 79034 - DNA, 601 bp, Human
agtttatgatgaattttctattaatgtaaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcag

SEQ ID NO: 79035 - DNA, 601 bp, Human
aattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctg

SEQ ID NO: 79036 - DNA, 601 bp, Human
aaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagc

SEQ ID NO: 79037 - DNA, 601 bp, Human
aaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgact

SEQ ID NO: 79038 - DNA, 601 bp, Human
aataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactt

SEQ ID NO: 79039 - DNA, 601 bp, Human
tagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaatt

SEQ ID NO: 79040 - DNA, 601 bp, Human
accttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctcgctaaacattgtcacttgccaaaccatgttttctgtttcatactaattttctactggcagtgagaccagcggaatctaagaaattgcatacgaaattcaaggattggaaag

SEQ ID NO: 79041 - DNA, 601 bp, Human
cccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctckctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaa

SEQ ID NO: 79042 - DNA, 601 bp, Human
aaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctcgctaaacattgtcacttgccaaascatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaatactctaatgagggaaacatcct

SEQ ID NO: 79043 - DNA, 601 bp, Human
tgaatgtcttctgtttctcgctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctag

SEQ ID NO: 79044 - DNA, 601 bp, Human
cctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgacagcaggaagcccagcttctct

SEQ ID NO: 79045 - DNA, 601 bp, Human
ttgggcaggtgattgtgatactataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcaca

SEQ ID NO: 79046 - DNA, 601 bp, Human
acccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcamactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattattattattagagacagggtcttgctttcttgcccaggaaggagtgcaatagtgtagtcatggctcactgcagccttgacctcctg

SEQ ID NO: 79047 - DNA, 601 bp, Human
gagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtt

SEQ ID NO: 79048 - DNA, 601 bp, Human
taggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggt

SEQ ID NO: 79049 - DNA, 601 bp, Human
cacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaag

SEQ ID NO: 79050 - DNA, 601 bp, Human
gaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaa

SEQ ID NO: 79051 - DNA, 601 bp, Human
ttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcata

SEQ ID NO: 79052 - DNA, 601 bp, Human
gtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattatt

SEQ ID NO: 79053 - DNA, 601 bp, Human
gattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcata

SEQ ID NO: 79054 - DNA, 601 bp, Human
ccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactg

SEQ ID NO: 79055 - DNA, 601 bp, Human
atgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacakcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattcctta

SEQ ID NO: 79056 - DNA, 601 bp, Human
ccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggt

SEQ ID NO: 79057 - DNA, 601 bp, Human
tctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttactgctcgattgcctggaagctaggtaataataaggattcaaactt

SEQ ID NO: 79058 - DNA, 601 bp, Human
tgtttagtgctttcttgttctaagaacctttaccaatcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttctttattt

SEQ ID NO: 79059 - DNA, 601 bp, Human
tcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttacygctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttctttatttataaacatttcagtgatatttgatgattttgaatgt

SEQ ID NO: 79060 - DNA, 601 bp, Human
gactgttgtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggctt

SEQ ID NO: 79061 - DNA, 601 bp, Human
atgagcatgcatctctccatttatttaaggcttctttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttgagacagacatcattgctttattcaggacttctctattatatgtgatcctagttgtatgttttctgtacctatacttcattagattaaggagtttgaatttatttctagtttgctgagagttcttttataaatgtgttcatatatatatgttttatatttttcttattcttactatctgcatattagagggagtttagctca

SEQ ID NO: 79062 - DNA, 601 bp, Human
tacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatmattgctttattcaggacttctctattatatgtgatcctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaa

SEQ ID NO: 79063 - DNA, 601 bp, Human
ttataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatcattgctttattcaggacttctctattatatgtgatsctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacac

SEQ ID NO: 79064 - DNA, 601 bp, Human
ttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaaygggaacattggccacatccgccattgtcaattttaaataaaagatatgatgactagttggtgagttgatcttgtaagacttttacagatacccagaacggctctacttcttcatattccactttttagttttaaaagtttaagtagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacactt

SEQ ID NO: 79065 - DNA, 601 bp, Human
ttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatcygccattgtcaattttaaataaaagatatgatgactagttggtgagttgatcttgtaagacttttacagatacccagaacggctctacttcttcatattccactttttagttttaaaagtttaagtagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggaca

SEQ ID NO: 79066 - DNA, 601 bp, Human
tatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaacccacagaggtccctattcacataagaattttctaagcagaggttccaatttggatatttcgtggccttcaggttatttgtaaccagtacacaaaccacaaagtcataatcagatagattttctttccagcctgtctttcc

SEQ ID NO: 79067 - DNA, 601 bp, Human
cctgtacatttgtttatgacgagattaaagtcttttctcctcctgttttgtgtcagctcagacactgaaggggaaagtttccagcctggtttctccatacactgaacatgttgaaatctatgccttaagcccaaatgaactgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttg

SEQ ID NO: 79068 - DNA, 601 bp, Human
gtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcaga

SEQ ID NO: 79069 - DNA, 601 bp, Human
atggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctgtttcattttctgttttgctccttcttttcataagtagctggtagtcagtgt

SEQ ID NO: 79070 - DNA, 601 bp, Human
ccattttcatagggcaaaatgcagagttcgggttccttcctatccatgagaataggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgc

SEQ ID NO: 79071 - DNA, 601 bp, Human
ttctgaggcatattattcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaasgcttttaccatggctaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaaggga

SEQ ID NO: 79072 - DNA, 601 bp, Human
ttcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatggcyaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcg

SEQ ID NO: 79073 - DNA, 601 bp, Human
gggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatggctaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaaca

SEQ ID NO: 79074 - DNA, 601 bp, Human
tggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagc

SEQ ID NO: 79075 - DNA, 601 bp, Human
catggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacatactgcataatgaggccttcaatgactctgatttggaactgaccctctatgaggggtta

SEQ ID NO: 79076 - DNA, 601 bp, Human
gcttagttctatgttactgaatatttcttaattaagtgcaggaaagaaaataaccattttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggac

SEQ ID NO: 79077 - DNA, 601 bp, Human
tggtaggcgcctgtaatcctagctagtcgggaggcagaggcaggagaactgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcagcctccggcagcatgactcctaaaccctaatttctaatcttgtggctaatttgttagtcctgcaaaggcagtctagtccccaggcaggaag

SEQ ID NO: 79078 - DNA, 601 bp, Human
aagtctcccccaaaactcagggatagagatttttaaggagaatttagtgagaagggggtcagggaatggggagtattgattggtcaggtttgagatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaata

SEQ ID NO: 79079 - DNA, 601 bp, Human
gtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaatgtagagggtcaggaaaacaatgatatgagaaaagggccggttactgtctgggaatccataaatactgcttggca

SEQ ID NO: 79080 - DNA, 601 bp, Human
aggagctgtatttcatgtcctgaaaagtgtgcacggttggcctcctctaggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcrtcaacttagtccaaatgtagagggtcaggaaaacaatgatatgagaaaagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatg

SEQ ID NO: 79081 - DNA, 601 bp, Human
gtcctgaaaagtgtgcacggttggcctcctctaggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaawgtagagggtcaggaaaacaatgatatgagaaaagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttt

SEQ ID NO: 79082 - DNA, 601 bp, Human
taggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaatgtagagggtcaggaaaacaatgatatgagaraagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctt

SEQ ID NO: 79083 - DNA, 601 bp, Human
ttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttattgggcatggagaagcagtcttttctttttcttgatggcctgggttgaccagatcctgacttttgtggagacattaaagtgctagaaatgataatggtga

SEQ ID NO: 79084 - DNA, 601 bp, Human
gtggctctccccagggcctcccttcttgttctccccagttgcagacctcagacaggagtctgcttgtcttcctaggcccttgtcagagtggaaggtggccctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttaytgggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccaacactttgggaagctgagacaggcagatcacttgaagtcaggagtttgagacc

SEQ ID NO: 79085 - DNA, 601 bp, Human
tgacctttaccataaatcacatatttgtaaactgtaccctcctgctgttttattgggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactaaaagtacaaaaattagccagacgtgatggtgcgtacctgtaatctcagctactcaggaggctgaggcaggagaatcacttgaacccgggaagcggaggttgcagggagctgagatcacgctgatgcattccagcctgggtgacagagcaggactccatctcaaaaagaaaaactcaacgaaacaccccagcttctatcattctcaagcttagt

SEQ ID NO: 79086 - DNA, 601 bp, Human
tggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccaacactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggttgcagggagctgagatcacgctgatgcattccagcctgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaat

SEQ ID NO: 79087 - DNA, 601 bp, Human
ctcttaggaaaattctccccagtggcaatgttgtaagaaacaccaggccgggcacagtggctcacacctgtaatcccaacactttgggaagctgagacaggcagatcacttgaagtcaggagtttgagaccagcctggccaacatggttaaaccccatctctactaaaagtacaaaaattagccagacgtgatggtgcgtacctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgagcctcaacttcctcatgtataaagtg

SEQ ID NO: 79088 - DNA, 601 bp, Human
ctgagatcacgctgatgcattccagcctgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgcgcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttacgtgtgttattttatttcatccttccagctctgggaggtgatgactgtcatctgcattttgcacatgacaaatctgagggtcagagaacttgcccagggt

SEQ ID NO: 79089 - DNA, 601 bp, Human
ttgaagcatgtcctatcattaacacaggtaatcaggatatattcattgaagtctcactgtgtgccaggcactatgctatgcaccttacgtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctc

SEQ ID NO: 79090 - DNA, 601 bp, Human
ttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcaca

SEQ ID NO: 79091 - DNA, 601 bp, Human
gttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctg

SEQ ID NO: 79092 - DNA, 601 bp, Human
caaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgccggtgagtgaatgagggagtgaatgaatgagggatttgcagcttgaacgctgtactttgaaacagttccagattcatgaaatttctttttaatgc

SEQ ID NO: 79093 - DNA, 601 bp, Human
cctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctc

SEQ ID NO: 79094 - DNA, 601 bp, Human
aattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccatttwaaaaaaaaaattgcaccagttctcatcccatcatctgccttgatcaaacatttgcttattggaatcacttcgaaaaggaacttggtatcgttcacatgtgtttataactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacct

SEQ ID NO: 79095 - DNA, 601 bp, Human
caatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccattttaaaaaaaaaattgcaccrgttctcatcccatcatctgccttgatcaaacatttgcttattggaatcacttcgaaaaggaacttggtatcgttcacatgtgtttataactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaat

SEQ ID NO: 79096 - DNA, 601 bp, Human
gggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccattttaaaaaaaaaattgcaccagttctcatcccatcatctgccttgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccagcacagtgtactcccgcacagataaccgtcccatct

SEQ ID NO: 79097 - DNA, 601 bp, Human
aactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaag

SEQ ID NO: 79098 - DNA, 601 bp, Human
ggattttgaatacttttgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgc

SEQ ID NO: 79099 - DNA, 601 bp, Human
gaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactgcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgacctgcattcgtgtaggaactgagcaaggttcatctagtctcggt

SEQ ID NO: 79100 - DNA, 601 bp, Human
gttaatgttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagastacctttctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagaga

SEQ ID NO: 79101 - DNA, 601 bp, Human
ttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagagtaccttyctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacaccccc

SEQ ID NO: 79102 - DNA, 601 bp, Human
ggtctagcacaggatcaccattggtagatcatcacttagaatgccatcactaccttctaacagcaatcagtccccttaagtggctttcttctcttttttttcttttatctttttgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagc

SEQ ID NO: 79103 - DNA, 601 bp, Human
ggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagt

SEQ ID NO: 79104 - DNA, 601 bp, Human
atacagctacgtcaaaatgccgcatttattttgccattacttttcactgactaaaaccatttgctaatgaaagttctagctgccataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaa

SEQ ID NO: 79105 - DNA, 601 bp, Human
actgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgata

SEQ ID NO: 79106 - DNA, 601 bp, Human
attgggtgattgcccacatatttgatctcagcctccaagtcaactgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcrtgaccttggctcactgcaatttctacctcccgggttcaagcaattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttataagaaaggattccaactttcccattta

SEQ ID NO: 79107 - DNA, 601 bp, Human
actgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcatgaccttggctcactgcaatttctacctcccgggttcaagcrattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttataagaaaggattccaactttcccatttacagagaaggaagctgaggctcacaggtttcactcaaaccata

SEQ ID NO: 79108 - DNA, 601 bp, Human
tctgtcgctcaggctggagtgcagtggcatgaccttggctcactgcaatttctacctcccgggttcaagcaattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagaca

SEQ ID NO: 79109 - DNA, 601 bp, Human
tccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacatttattagttggcttctgtgtgggwgagtaaccattaataccttgaataagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgtt

SEQ ID NO: 79110 - DNA, 601 bp, Human
tcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacatttattagttggcttctgtgtgggagagtaaccattaataccttgamtaagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatg

SEQ ID NO: 79111 - DNA, 601 bp, Human
agatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggc

SEQ ID NO: 79112 - DNA, 601 bp, Human
ctgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaatgtaactgtctataatttctcttggttactgaaattctgagtttgtgtctatggtttctccatccttgtctttgaggaggagcaggatggcgaagtcgcagccatttaaaaacttgttttcagtcattttgca

SEQ ID NO: 79113 - DNA, 601 bp, Human
ggagtggatggacccaaaatgggtggatcatttgagcccaggagtttgagaccagcctgggtaacatggcaaaaccttacctctcaaaaatttacaagcttagccaggcatggtggtgcccacttgtggtttcagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaa

SEQ ID NO: 79114 - DNA, 601 bp, Human
gaaggcttactgcagcctctacttcctgggctcaagtgatcctcccacctcagcttcctaagtagctgggagcacaggcaccagcaatgacacctgcctaattttgtattttctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtccactgtttatcctggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagt

SEQ ID NO: 79115 - DNA, 601 bp, Human
gggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcstccagcagagcctgctcttggtccactgtttatcctggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcacta

SEQ ID NO: 79116 - DNA, 601 bp, Human
ggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtcyactgtttatcctggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataact

SEQ ID NO: 79117 - DNA, 601 bp, Human
cagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttgtgtgtgtgtgtgtatgtgtgtgtgcgtgttatatgaagtcttgctagaatgcataaacaaacaaaaaaaatatcatactctcagatcctggatactgtggtcgcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctc

SEQ ID NO: 79118 - DNA, 601 bp, Human
gcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtggatgtgtgtgtgcgtgttatatgaagtcttgctagaatgcataaacaaacaaaaaaaatatcatactctcagatcctggatactgtggtcgcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccg

SEQ ID NO: 79119 - DNA, 601 bp, Human
ttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaatatcatactctcagatcctggatactgtggtcrcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtat

SEQ ID NO: 79120 - DNA, 601 bp, Human
tgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaatatcatactctcagatcctggatactgtggtcgcctggacttcaaaagccttttgyccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcac

SEQ ID NO: 79121 - DNA, 601 bp, Human
cctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactgg

SEQ ID NO: 79122 - DNA, 601 bp, Human
tccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcgctatgcaaggcactgaggtgacaaagacaagcagaatgacagttaaatgtaacatgggctttgtggtcaattagttctg

SEQ ID NO: 79123 - DNA, 601 bp, Human
cgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcrctatgcaaggcactgaggtgacaaagacaagcagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcct

SEQ ID NO: 79124 - DNA, 601 bp, Human
acaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcgctatgcaaggcactgaggtgacaaagacaagsagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacaga

SEQ ID NO: 79125 - DNA, 601 bp, Human
ataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtgaggatacaaaggcaatgagtacatgatccttgaccttgagaaacctatagt

SEQ ID NO: 79126 - DNA, 601 bp, Human
gcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtaccc

SEQ ID NO: 79127 - DNA, 601 bp, Human
tcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggat

SEQ ID NO: 79128 - DNA, 601 bp, Human
gttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgctcttgc

SEQ ID NO: 79129 - DNA, 601 bp, Human
tgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgac

SEQ ID NO: 79130 - DNA, 601 bp, Human
agaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagactatatccacatcacagagagctggccca

SEQ ID NO: 79131 - DNA, 601 bp, Human
ggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagactatatccacatcacagagagctggcccattgctcagggcctgggaagtggtagggagggaccttcccagaagagagatgactcaggctggtcccaagcccct

SEQ ID NO: 79132 - DNA, 601 bp, Human
gcctggataagaacatgctgcgtcagagagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttggg

SEQ ID NO: 79133 - DNA, 601 bp, Human
ttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgrgcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacc

SEQ ID NO: 79134 - DNA, 601 bp, Human
gactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgggcatggtgtyacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacccgagactggg

SEQ ID NO: 79135 - DNA, 601 bp, Human
agtgtctactaaaaatacaaaaattagctgggcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccataattcaattacctcccaccagcttcctcccacgacatttgggaattgtgggagttacaagttgcaattcaacatgaga

SEQ ID NO: 79136 - DNA, 601 bp, Human
agaccaaggtggtggaataggttaggttaggatacgtcggaggagccagtgtgaactgctcctttaagacatgaattagcccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagc

SEQ ID NO: 79137 - DNA, 601 bp, Human
ttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacrtggtgaaaccccgtctctactaaaaatagaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgca

SEQ ID NO: 79138 - DNA, 601 bp, Human
acacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacgtggtgaaaccccgtctctactaaaaatasaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgca

SEQ ID NO: 79139 - DNA, 601 bp, Human
ctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaa

SEQ ID NO: 79140 - DNA, 601 bp, Human
ggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcasaattccaggacgtctcaaatttctggctggtacaccctgggtaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactcttt

SEQ ID NO: 79141 - DNA, 601 bp, Human
tcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccytgggtaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatgga

SEQ ID NO: 79142 - DNA, 601 bp, Human
agtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccctgggyaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagcca

SEQ ID NO: 79143 - DNA, 601 bp, Human
cccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacatgggtactggagagtgggaggcccagtcacggggaatgctggcttagcacaactgaaa

SEQ ID NO: 79144 - DNA, 601 bp, Human
gtctctgggcattttagtttattcattcatttgttcatttattccacagggatttattatgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacrtgggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataa

SEQ ID NO: 79145 - DNA, 601 bp, Human
ttgttcatttattccacagggatttattatgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacatgggtactggagagtgggaggcccagtcasggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataatcgtcaacgtatattcatggagcatcttct

SEQ ID NO: 79146 - DNA, 601 bp, Human
tggcccattataccagataaagtgatagagaggggctggcgaggagagcagtctaatttcaggaaagtcagaaaagtctttaaggaaactgaaggctgagctgccagggccagccacatgggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggyagccacaggagggctttagacaggaccgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccagtgactctacaattgctgggat

SEQ ID NO: 79147 - DNA, 601 bp, Human
gagaggggctggcgaggagagcagtctaatttcaggaaagtcagaaaagtctttaaggaaactgaaggctgagctgccagggccagccacatgggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggacmgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccagtgactctacaattgctgggatactttttagaattttctttttgtgcat

SEQ ID NO: 79148 - DNA, 601 bp, Human
ggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccagtgactctacaattgctgggatactttttagaattttctttttgtgcattacttttgattcttggttctttctttggcattagctcaccagtggcaaatatgtatcctttaagggtggacttaattttttgagaaatggcca

SEQ ID NO: 79149 - DNA, 601 bp, Human
tttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtartgtgtgtcccttacagatgatgcccagtgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaa

SEQ ID NO: 79150 - DNA, 601 bp, Human
ggaatttctaaatggagtgggcagccacaggagggctttagacaggaccgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccartgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaatta

SEQ ID NO: 79151 - DNA, 601 bp, Human
atggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggccsaagtttacccaattcgactgcccccacccagatagaatattcatggttagaccataaactacataactggaaattttaaatctatttttatatgcatacaaaaactgcaggcctgaagcttctaaaaataaacgttactttcatcccattatagaaaaatgcatttgaggtggtcatcattttatttgggccagggtcttccgagacttgggacaataatatattttttctactttaggcaaatgtatgcagattcttaaagcatgaatgctgtattacacacattataaattcgagtaa

SEQ ID NO: 79152 - DNA, 601 bp, Human
atgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggcccaagtttacccaattcractgcccccacccagatagaatattcatggttagaccataaactacataactggaaattttaaatctatttttatatgcatacaaaaactgcaggcctgaagcttctaaaaataaacgttactttcatcccattatagaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtg

SEQ ID NO: 79153 - DNA, 601 bp, Human
cagttctccaaattccacttccccttttagcctgcctcccttccgtcatccttcatcaaggtgacataggtctggcgatctttttggcatagacgtgtggacgttgtttttgacatttgtacatgcttttgctcaagttgaaggcccaagtttacccaattcgactgcccccacccagatagaatattcatggttagaccataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtataaaataacctctgtggtatttgtttaccctgattttttgatttatgagtcgtcattgctcgctatagaagaagaaaaataaatatgcaaaacagtggtagattttt

SEQ ID NO: 79154 - DNA, 601 bp, Human
agaccataaactacataactggaaattttaaatctatttttatatgcatacaaaaactgcaggcctgaagcttctaaaaataaacgttactttcatcccattatagaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagta

SEQ ID NO: 79155 - DNA, 601 bp, Human
aaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttccttttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcc

SEQ ID NO: 79156 - DNA, 601 bp, Human
ttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacct

SEQ ID NO: 79157 - DNA, 601 bp, Human
gtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactc

SEQ ID NO: 79158 - DNA, 601 bp, Human
acgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttkgtttgttggcttatgttcgctgcttgatctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcgtagtcactggataaggagccagtcctggctcttcctttaac

SEQ ID NO: 79159 - DNA, 601 bp, Human
attgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttggtttgttggcttatgttcgctgcttgrtctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcgtagtcactggataaggagccagtcctggctcttcctttaactgcccttgtgaccttgaacatgtcagt

SEQ ID NO: 79160 - DNA, 601 bp, Human
aatatgctggccttttagtcttttggttttttctctcttttggtttgttggcttatgttcgctgcttgatctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctccagttaattttactttaattccccctacaagaatgcc

SEQ ID NO: 79161 - DNA, 601 bp, Human
tcgtatgggttgagcatggagggaacttcatctcgtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctccarttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgtctcagtctcccaagtagctgggattacagggatgcgccaccatgcccagctaattttttgtatttttagtagagacggggtttcaccatgttggccaggctggtcttgaactc

SEQ ID NO: 79162 - DNA, 601 bp, Human
tactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgtctcagtctcccaagtagctgggattacagggatgcgccaccatgcccagctaattttttgtatttttagtagagacggggtttcaccatgttggccaggctggtcttgaactcctgacctsagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcagagttcaccctggaagacagagtttctttctgtcttcatcctagggcacaggagagatgcagtgatggcatgtctccactctgcagacatgttgcaggcctggaaaactgtgtggtgcgtctgtttttcagagcgttga

SEQ ID NO: 79163 - DNA, 601 bp, Human
ctccagtgattctcctgtctcagtctcccaagtagctgggattacagggatgcgccaccatgcccagctaattttttgtatttttagtagagacggggtttcaccatgttggccaggctggtcttgaactcctgacctgagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcasagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacac

SEQ ID NO: 79164 - DNA, 601 bp, Human
gtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaagagggactttgttcccsctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggca

SEQ ID NO: 79165 - DNA, 601 bp, Human
gcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatt

SEQ ID NO: 79166 - DNA, 601 bp, Human
atcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgagraaacgctctcttcttcttgcaggggagggctggcaaattcagtgaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaaaaagaatgtgccacctagatgctatttataaccatt

SEQ ID NO: 79167 - DNA, 601 bp, Human
ttgcttttgagtgctaactgagatgaaaggagtgaggaaacgctctcttcttcttgcaggggagggctggcaaattcagtgaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacga

SEQ ID NO: 79168 - DNA, 601 bp, Human
aaaagccaaaaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaaga

SEQ ID NO: 79169 - DNA, 601 bp, Human
caaaaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaagaacttct

SEQ ID NO: 79170 - DNA, 601 bp, Human
ttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttatgagtgagccagaggtctgtctcttgcggcatttctgcttttgagaacctcccgtttcctgaaaggcaccagaccccaagacagctctgctgcctgattggtagatgcccatgacagctc

SEQ ID NO: 79171 - DNA, 601 bp, Human
aaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttg

SEQ ID NO: 79172 - DNA, 601 bp, Human
tttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgcgaagcacttttcatgcattatttaacctagctataatactcccatttgacagatgagaggactgaggcttgtagactttccaaggctgtgcagctct

SEQ ID NO: 79173 - DNA, 601 bp, Human
gctcgtgttaactccatctggacaaagccttgaggtatacgtgtggcttcttttgagcatcgtgccatagctgtccctgatctaccttgcggggcaaacacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatgcttttccaatattccctcctaatctttcagttgaattatggtc

SEQ ID NO: 79174 - DNA, 601 bp, Human
cagtatttatctactgtttattgtattccaggtaaaggatatgcgaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatscttttccaatattccctcctaatctttcagttgaattatggtctttagctcaaatgcatgacatgatgtgtgtgcctttggagtggggcggtattagtcagtcgatggttatttccttgaggagaaaggaaaggagaagttgagtacttttcagtgtttgttactacaaaagcatggtggcatgccattgttctgagaggaagggggttttttgccttgtcagctcctgatgaaaaagatgttgggttggaaagctaagttacagcaggtgaacttgaatttgaggaaagacaaagcaaa

SEQ ID NO: 79175 - DNA, 601 bp, Human
tatgcgaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatgcttttccaatattccctcctaatctttcagttgaattayggtctttagctcaaatgcatgacatgatgtgtgtgcctttggagtggggcggtattagtcagtcgatggttatttccttgaggagaaaggaaaggagaagttgagtacttttcagtgtttgttactacaaaagcatggtggcatgccattgttctgagaggaagggggttttttgccttgtcagctcctgatgaaaaagatgttgggttggaaagctaagttacagcaggtgaacttgaatttgaggaaagacaaagcaaaccctggctattaaaggaacacacacacacacatacacac

SEQ ID NO: 79176 - DNA, 601 bp, Human
caaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatgcttttccaatattccctcctaatctttcagttgaattatggtctttagctcaaatgcatgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaagggggttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacacgtttctggtattaggaaatggagatttctaacataataaaaaagattgaacttaaaaatgacttccatt

SEQ ID NO: 79177 - DNA, 601 bp, Human
ggctctgattgtctcttcttattatagtgcaaggtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgaytggcaactgggaagcctaagggtggatctggcgtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagacc

SEQ ID NO: 79178 - DNA, 601 bp, Human
gtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgattggcaactgggaagcctaagggtggatctggcrtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatc

SEQ ID NO: 79179 - DNA, 601 bp, Human
attgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgtagcaaagtgatctttttgagacccaaatgtgagtatgccattctaatcttccc

SEQ ID NO: 79180 - DNA, 601 bp, Human
tcttgttttaggatcattgccagtggaattcaggactgcggttctacccggtaccggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaa

SEQ ID NO: 79181 - DNA, 601 bp, Human
tcaatggatgtgggtgagaggacagtggaatccagcaggggccattgtttccttccataatatttttaaactgtagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcc

SEQ ID NO: 79182 - DNA, 601 bp, Human
cccagtgacctagcccccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcc

SEQ ID NO: 79183 - DNA, 601 bp, Human
ccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtt

SEQ ID NO: 79184 - DNA, 601 bp, Human
aagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttg

SEQ ID NO: 79185 - DNA, 601 bp, Human
agctgagaccacaggcacgggacaccatgccagtctaatttttaaattttttgtagggacagggcctcactgtgttgcccaggctcatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctatttttactggagcatgtgagggtggatcacaactaggatggcgcgaagttcacctcgtgtaagcaca

SEQ ID NO: 79186 - DNA, 601 bp, Human
catctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcaatgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctatttttactggagcatgtgagggtggatcacaactaggatggcgcgaagttcacctcgtgtaagcacaccaggctgcagggataataactgcactttttaaaaccagcaaatcattcatatttactttatgaaacctcttttaactttatttt

SEQ ID NO: 79187 - DNA, 601 bp, Human
tgctgttagggtcagctggaggagagactgcaggggtcagagatcagggccatatgctagagctgcaatgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggccttgctctattgcccaggctggatggagtgcagtggcccaatcatggcagcctcagcctcctaaactcaagcag

SEQ ID NO: 79188 - DNA, 601 bp, Human
gatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccacc

SEQ ID NO: 79189 - DNA, 601 bp, Human
agtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacamaaaaaacttttttttttagaactgttttagtttgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacc

SEQ ID NO: 79190 - DNA, 601 bp, Human
cctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagttkgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtg

SEQ ID NO: 79191 - DNA, 601 bp, Human
aagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatt

SEQ ID NO: 79192 - DNA, 601 bp, Human
atcatatattgtatcatatcatatcatgtcatatcatatcatatcataccgaataatttcattgccctaaaatacctctgttttcactttttaatctctttgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgaatgttgcaatctgaggtatctgcccttaaagaagcaatatttac

SEQ ID NO: 79193 - DNA, 601 bp, Human
gtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagcca

SEQ ID NO: 79194 - DNA, 601 bp, Human
gtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttc

SEQ ID NO: 79195 - DNA, 601 bp, Human
attgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatgktgccttgcagtttccaaagtaagctgaacagtgttttttaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttggggtagtgggcacaggggaaggaaggttatgtaattttaaaa

SEQ ID NO: 79196 - DNA, 601 bp, Human
aaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatggtgccttgcagtttccaaagtaagctgaacagtgttttytaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttggggtagtgggcacaggggaaggaaggttatgtaattttaaaattcttcctttgattcaaaagaaaaaaacatgtttgttg

SEQ ID NO: 79197 - DNA, 601 bp, Human
acaatccatagcaggtagttttgccaatttgggaagttatggtgccttgcagtttccaaagtaagctgaacagtgttttttaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatct

SEQ ID NO: 79198 - DNA, 601 bp, Human
cctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacgg

SEQ ID NO: 79199 - DNA, 601 bp, Human
taccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccatggagtatctttactcacttgtgatgagat

SEQ ID NO: 79200 - DNA, 601 bp, Human
tgtgccatcagctactgggatgtatgactttccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaa

SEQ ID NO: 79201 - DNA, 601 bp, Human
gagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatat

SEQ ID NO: 79202 - DNA, 601 bp, Human
atgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttg

SEQ ID NO: 79203 - DNA, 601 bp, Human
gaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgcttttt

SEQ ID NO: 79204 - DNA, 601 bp, Human
ctgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatcttaacttgaatcgtatctcccagaattcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatga

SEQ ID NO: 79205 - DNA, 601 bp, Human
ctcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtrtctcccagaattcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaat

SEQ ID NO: 79206 - DNA, 601 bp, Human
cttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtatctcccagarttcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagt

SEQ ID NO: 79207 - DNA, 601 bp, Human
tgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtatctcccagaattcccacgtgttgtgggagggacccagggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaacatatctgaaaatgtggaagtgactttggaactgggtaacaggaagaagttagaaccgttgggaggtctcagaagaagacaggaaaatgtgggaaagtttggagctt

SEQ ID NO: 79208 - DNA, 601 bp, Human
acccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaasatatctgaaaatgtggaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttga

SEQ ID NO: 79209 - DNA, 601 bp, Human
attgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaacatatctgaaaatgtsgaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagg

SEQ ID NO: 79210 - DNA, 601 bp, Human
ggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgtgtaagtggcaaggaacctaatgttaatctcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagc

SEQ ID NO: 79211 - DNA, 601 bp, Human
gctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaaaacccattttctggggagaaattcaagctggctgcagaaatttgkgtaagtggcaaggaacctaatgttaatctcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggca

SEQ ID NO: 79212 - DNA, 601 bp, Human
tcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaaaacccattttctggggagaaattcaagctggctgcagaaatttgtgtaagtggcaaggaacctaatgttaatstcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggcacagaagtcaagaattggggtttgggaac

SEQ ID NO: 79213 - DNA, 601 bp, Human
aaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctagcataaactatgttactcaacccagttctgtcgtcgtcatttttt

SEQ ID NO: 79214 - DNA, 601 bp, Human
tgaggtgaggagttcgagaccagcctggtcaacatggtgaaaccccatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagcaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagt

SEQ ID NO: 79215 - DNA, 601 bp, Human
gtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctagcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaat

SEQ ID NO: 79216 - DNA, 601 bp, Human
tttttttttttttttttttttgagactcactctgtcacccaggctggagtgcagtggcatgatcatggctcactgcagcctcccgggctcaagctttccacccacctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtcattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcagg

SEQ ID NO: 79217 - DNA, 601 bp, Human
ggagttctcaccaaccttgcaaaatgagatggcaatcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccagg

SEQ ID NO: 79218 - DNA, 601 bp, Human
attagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggccccagtggccsttgtcttgttatttcctccattagagacctggcgtataattgtgggagggagaagccagtggagcagtcaggggactccctggctgtttctgtgtctggtcttatgggtctgggcactgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcacc

SEQ ID NO: 79219 - DNA, 601 bp, Human
gcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggccccagtggcccttgtcttgttatttcctccattagagacctggcrtataattgtgggagggagaagccagtggagcagtcaggggactccctggctgtttctgtgtctggtcttatgggtctgggcactgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcaccctccatctccctggttcaagggattctcgtgcct

SEQ ID NO: 79220 - DNA, 601 bp, Human
ggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctgagtagcacatcgtggaa

SEQ ID NO: 79221 - DNA, 601 bp, Human
caaaaaagccagtcacaaaggaccctatgttatatgatttcatttacatgaaataccccaaagaggcaaatctgcagaaacagaaagtagagtggttgccaggggctggggatggggtgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggact

SEQ ID NO: 79222 - DNA, 601 bp, Human
atgatttcatttacatgaaataccccaaagaggcaaatctgcagaaacagaaagtagagtggttgccaggggctggggatggggtgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtstaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactttctctagttcactgtgaatggtttttgaataa

SEQ ID NO: 79223 - DNA, 601 bp, Human
tttcatttacatgaaataccccaaagaggcaaatctgcagaaacagaaagtagagtggttgccaggggctggggatggggtgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaaygctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactttctctagttcactgtgaatggtttttgaataacatc

SEQ ID NO: 79224 - DNA, 601 bp, Human
ttgtatgaaaactgtgatgggattcaagtagtctaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcaaggtagaaggaacagtatgaggaaagtcagagagctaacaaagatt

SEQ ID NO: 79225 - DNA, 601 bp, Human
agtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtatatatatatgtatacatatgtatatgtatatcaatatatatatcaggtaagattctagtccagtgtgagccatatgctttattcctgagcaatcgctgtggtcaagagatagactttttagggccgggcacggtggcctacac

SEQ ID NO: 79226 - DNA, 601 bp, Human
tattagtcgtgattcttggggggcaactaaacccagcttttggcaaaagggagtatgttggttcatgtaccaggaagtcttggagtgatggcttcaggcacggctggatccaggggctcaaaaatataatcagatgatttgtttgcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgctgaaatcccatctctactaaaaatacaaaaattaggtggcaggcacttgtaatcccagctactcagaaggctga

SEQ ID NO: 79227 - DNA, 601 bp, Human
agaaaatccagattcccattctcatgctagcttcataacagcaggagagctcctcactctgtttcccagggtgtatatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgc

SEQ ID NO: 79228 - DNA, 601 bp, Human
aaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgagtcatgtctctgataaatcgcccccccaccccgatccccaccctctgccgccccggccttctttttgtrctgttgggttccaaactttacctgaggattttcacatgcacatctgttaaatgccatttaaagagaacactaacaagagaaagctagttcatttttcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgc

SEQ ID NO: 79229 - DNA, 601 bp, Human
ccctgacgggtcaaatggagcaaagtgtgcttcccagaagagcataagaaaaaggaagggtactgggtggaccaaatctattgttacaatatcccttatattccttagggttcctttttttcaagttaaagcattgagtcatgtctctgataaatcgcccccccaccccgatccccaccctctgccgccccggccttctttttgtgctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcag

SEQ ID NO: 79230 - DNA, 601 bp, Human
tgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtsagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaac

SEQ ID NO: 79231 - DNA, 601 bp, Human
aggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtgagcgccrtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaactgcagag

SEQ ID NO: 79232 - DNA, 601 bp, Human
ccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaactgcagagcctatttttctttcccttccagctcagctgccttctcctccctgacctcaggtcacccaagactcccactttatgatttccttttacttttagttcattattctctgtgattcagtggaaa

SEQ ID NO: 79233 - DNA, 601 bp, Human
taagacatctgctcagagtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtstaaatgttccatttacattgaatggcacatgtcataaagtacataccgctgcacatcccaccctctgtttctgtttcaactgcagagcctatttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgcc

SEQ ID NO: 79234 - DNA, 601 bp, Human
agtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttamattgaatggcacatgtcataaagtacataccgctgcacatcccaccctctgtttctgtttcaactgcagagcctatttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctg

SEQ ID NO: 79235 - DNA, 601 bp, Human
tattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagacccgtaattgattcataagatcccttcctccgatcgcattgaaga

SEQ ID NO: 79236 - DNA, 601 bp, Human
ctatttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagrcccgtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgc

SEQ ID NO: 79237 - DNA, 601 bp, Human
tttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagaccygtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgcttt

SEQ ID NO: 79238 - DNA, 601 bp, Human
caaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcgggagtgggggcaccagggctcatgagccgagagcccctgcttcccttggaaaacggaaatttctatctccaactagggaaaaatttgcatgtgtagaattttggttttttcttcggcgtgtttatttaatttaacattacctatcctacgattatttcaaggtgattttattactagtcagctttcttttccctagcacaaaactcatgcaacatttatgttgaatgt

SEQ ID NO: 79239 - DNA, 601 bp, Human
gatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaaaagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaattttggttttttcttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcct

SEQ ID NO: 79240 - DNA, 601 bp, Human
aacttcagggttttattttgtttgctttgctttgccttgtctggtttttcaaagtgctcttttaacaaatgaaagtttaaagcttgagttcaatttgagtaatttgttcccagagaaaaagtaaatgaaaagtatttctgggtatttttaatgacacaagtttctgtgctgatatgcgggcaggggttcgggagtgggggcaccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagaga

SEQ ID NO: 79241 - DNA, 601 bp, Human
acgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaacatcttaattgaacagcacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttcctt

SEQ ID NO: 79242 - DNA, 601 bp, Human
acgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagacccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacattt

SEQ ID NO: 79243 - DNA, 601 bp, Human
attgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggacagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatg

SEQ ID NO: 79244 - DNA, 601 bp, Human
tgcagttttgttttttatttagcacaaacctaaatattacacgtagcaaatgtcacccgatgcaactgtctgtcctgaagaggaggacagattattctgtggctacctaatggtgtttacagagttgccactttgccaaaccccaagacccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactctggaccagaattgattgccaccaataaaagatactccagtccttaaaaagtcaacattgttatgttttacttagttatgacttag

SEQ ID NO: 79245 - DNA, 601 bp, Human
aatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgt

SEQ ID NO: 79246 - DNA, 601 bp, Human
ttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcaagatggaat

SEQ ID NO: 79247 - DNA, 601 bp, Human
ttttttcattatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccgtaaggacccttgccattaggaccaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaaca

SEQ ID NO: 79248 - DNA, 601 bp, Human
cagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcaagatggaattcagcctttcagacaattctgccaggcccttggagggtgggaggaaacaggcaagacctctggctcctagaaccrtaaggacccttgccattaggaccaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctg

SEQ ID NO: 79249 - DNA, 601 bp, Human
gtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcaagatggaattcagcctttcagacaattctgccaggcccttggagggtgggaggaaacaggcaagacctctggctcctagaaccgtaaggacccttgccattaggascaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctggcacagagtaggcactggataa

SEQ ID NO: 79250 - DNA, 601 bp, Human
ataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaactgtttgttttgaaccacttattttggcaagacttcttcagacaggagagccctgagagctcttcaaaggctgggcctgatggtgtttgtcagag

SEQ ID NO: 79251 - DNA, 601 bp, Human
ttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaactgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcgttatgaccatagaagtttgtggggtggcactctttattctgtcctcgccccgcaagcaaagcacacaccacaagctataaggagatgagctcagtaggcctgtcctttactttattttccctattagaatcccaccatagacgccctctctgcatgtgtccttgtctgggggagtcgcttaatttcctttttctttgagg

SEQ ID NO: 79252 - DNA, 601 bp, Human
tgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaataccgcatctatctatttccaaaatatttgtatctccccacaataaaagtctgtaccaattaagcagctactacccattcctcttccctaccattctaccttctgtctcagtaggtttgcctatttgggatattttatttaagtgsgatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaa

SEQ ID NO: 79253 - DNA, 601 bp, Human
atgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatccaaaccttatcaccagcgcttgttatttcctcaggtacatt

SEQ ID NO: 79254 - DNA, 601 bp, Human
gcatagaagcttctgctactgggggcgcctcaggaaacttataatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaa

SEQ ID NO: 79255 - DNA, 601 bp, Human
tcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaatcagctagcgatggctaaggctcctgtgagggtttctacagaggttccacccagagaggagagtcaaatgggagtttctaccgatgctcttgaaaggatcttgttactcagatgtctctaagacaatgatcagtacccatctctcagagcctgtgcagccgtccatgcttgaggcatgagatgctgaagataaaggtccc

SEQ ID NO: 79256 - DNA, 601 bp, Human
atttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatcctg

SEQ ID NO: 79257 - DNA, 601 bp, Human
aagcgttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcactt

SEQ ID NO: 79258 - DNA, 601 bp, Human
aatcctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttagg

SEQ ID NO: 79259 - DNA, 601 bp, Human
cgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctcyaagaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtc

SEQ ID NO: 79260 - DNA, 601 bp, Human
ctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctccaasaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaat

SEQ ID NO: 79261 - DNA, 601 bp, Human
gaataggggccaggcgtggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaagaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtggga

SEQ ID NO: 79262 - DNA, 601 bp, Human
gatgcgcaagagactccttttgactgcaaggactcagtaaaacaaagtatttcaaggtcatgctacaaaaagtcccaccaagagcatggtcaggaggtacagtgcacttacccacacggatcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagac

SEQ ID NO: 79263 - DNA, 601 bp, Human
gctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaa

SEQ ID NO: 79264 - DNA, 601 bp, Human
gtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaata

SEQ ID NO: 79265 - DNA, 601 bp, Human
tgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctactcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcag

SEQ ID NO: 79266 - DNA, 601 bp, Human
tcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccggcatgttgctgcgagccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagatgctgaacccttattgtatctccccagggttagtgagtaattgggaatagtgttccatcttggatgcccccatccactaaccagctttcctcttcgggtggttctaagaatt

SEQ ID NO: 79267 - DNA, 601 bp, Human
tgttgctgcgagccccaatcgatcagtggagaaacgagctctggtgggcagtcaggcaaagcagatacacgtgcttcttttcagctttgttggaaggtttcattttgcttcaggaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctaatgcagtcaaaccaccctgcagaatcttaacagcaccacaaatattgcatccaggcatcc

SEQ ID NO: 79268 - DNA, 601 bp, Human
cttgtgtttggggataaatactgagactgagcagtcttgtggattcaggaattgggcatccagttgggaccctttgcaagaagggtgttagggagcagagagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcaggagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagac

SEQ ID NO: 79269 - DNA, 601 bp, Human
gagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcasgagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattg

SEQ ID NO: 79270 - DNA, 601 bp, Human
gaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcaggagttcgaggctagcctgggcaacacggcaaagscctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattg

SEQ ID NO: 79271 - DNA, 601 bp, Human
gtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcaggagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctaggg

SEQ ID NO: 79272 - DNA, 601 bp, Human
tccaggtacagtggctcatgtctgtaattctagcactttgggaggccggggcgagcaaattgcttgaactcaggagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagggtccggagctactaaaggtcaacagctgtgttattgcaaactctgtggcctgcat

SEQ ID NO: 79273 - DNA, 601 bp, Human
tgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatcccagcattttgggaggctgagatgggaggatcacttgagcccaggagtttgaggccagcctggtcaacacaaggagacttcatctctataaataataaaaaaattaaaaattagctgggtgtggtggtgcacacctgtagtc

SEQ ID NO: 79274 - DNA, 601 bp, Human
ggaatctacccacctgtgatgtgctagttactaaagatgcagcaatgaatgaaaggtaatcctgtccttgaggcattcacaggtaaagaagcctgcttgggacattgggccgtgagctccaacaatgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatggatgtgagcgtctgcgtaggtttttatttttctctctcagaatgaaaggtttgattcgtaccagctccccatcccttcccacgatcccatcttaatgtctgttgtggaagttggcccacagaagcctc

SEQ ID NO: 79275 - DNA, 601 bp, Human
agaccaactcccttatctgcctgtacagtgttctgcgaatcccggtctctactaaaaatacgaaaaaaattagccaggtgtggtggtgggtgcctgcaatcccagctactctggaggctgaggcaggggaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctgttgtggaagttggcccacagaagcctcaaggctaaccaacaagaaagatcacttcatatgcattagctggaaggtaacaagaggaaatcgcctgccagggtccctgactcccggaggaaagtgtcctctgagccctccttgagggacataaatagccccaaaagtcactgaatgctaagttggctttctccccaaacctt

SEQ ID NO: 79276 - DNA, 601 bp, Human
tggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagttcactgtgcccttagataataacagtttgtcttggctctgatcacccctttttgtgacttagctggctgggaagtagcaaaagtatcttccaagctcagcttctctctgcttgcattctttccaaatacgtgattccaaagcccatgcccaatccttgcactgaagcttttagcaggaaaggtgaacagaggcatctggat

SEQ ID NO: 79277 - DNA, 601 bp, Human
ggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgkttttcctcccagcctctctcctttcccattatgcacaatgcgctgagaaaggattcccagtccccctggtaaaaagtctgaaggatgccgaggagttcactgtgcccttagataataacagtttgtcttggctctgatcacccctttttgtgacttagctggctgggaagtagcaaaagtatcttccaagctcagcttctctctgcttgcattctttccaaatacgtgattccaaagcccatgcccaatccttgcactgaagcttttagcaggaaaggtgaacagaggcatctggatgca

SEQ ID NO: 79278 - DNA, 601 bp, Human
ggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagttcactgtgcccttagataataacagtttgtcttggctctgatcacccctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgccccttgcccaattccctcccctctcctgcgtacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctgg

SEQ ID NO: 79279 - DNA, 601 bp, Human
ggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccccttttcagctgggtgctccctggaagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactg

SEQ ID NO: 79280 - DNA, 601 bp, Human
ttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagacmccttttcagctgggtgctccctggaagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcataatgatcagcttcattctctccctttccctctctctccacacctttccattcctcctaactaatgtgggagagaag

SEQ ID NO: 79281 - DNA, 601 bp, Human
tgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccmcttttcagctgggtgctccctggaagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcataatgatcagcttcattctctccctttccctctctctccacacctttccattcctcctaactaatgtgggagagaaga

SEQ ID NO: 79282 - DNA, 601 bp, Human
tttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccccttttcagctgggtgctccctggaagatggatcttgccttgtggatgtttttctaccgtgacagaagatagaaaggatgaaatagaaagagtgtgagtgaattctgcacccaccmcccccccccagcttccccacctgtaaaatgatttgctcaaagtttgcaaagaatggaggcatattcaaagtgctcagcactgggccggacccatgggtatgaattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggaca

SEQ ID NO: 79283 - DNA, 601 bp, Human
tggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggattacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagag

SEQ ID NO: 79284 - DNA, 601 bp, Human
attgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgct

SEQ ID NO: 79285 - DNA, 601 bp, Human
ctttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgt

SEQ ID NO: 79286 - DNA, 601 bp, Human
cctaattccatggaacctataaatatgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctstcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactca

SEQ ID NO: 79287 - DNA, 601 bp, Human
atgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacraagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcagg

SEQ ID NO: 79288 - DNA, 601 bp, Human
tgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaaccgaggccggttagagacaggctggcagctttgcctyctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagagaaattaagtcgaagtacattttgcccatagagattatc

SEQ ID NO: 79289 - DNA, 601 bp, Human
gaaccgaggccggttagagacaggctggcagctttgcctcctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagacttcaaattgagccagacctcaggcatgaagggaggggagagagggggaaatgtggaggaagggggcgtttgtgcagtgggaagttggagaaagtacaaatgaaagcctctctgcagtgaacctcatgact

SEQ ID NO: 79290 - DNA, 601 bp, Human
acaaatctgggcaactggaatttattgtaatggtaaattacactaataataatctggggatgaaaacagggcaggcagtgaaacctgaatctcagctggacgatgaatgagttttaatgtaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgc

SEQ ID NO: 79291 - DNA, 601 bp, Human
tcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctat

SEQ ID NO: 79292 - DNA, 601 bp, Human
tttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcaccyggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgct

SEQ ID NO: 79293 - DNA, 601 bp, Human
gcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcacccggcccctgcctttttattttgctaaacctgatgacccttgccatagcagaactaaagtgatgatgatgattacagcagatcarttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactccctcttcgagatgctgatttggaaaataactccatgatgaaacatgtcaagggagactgcct

SEQ ID NO: 79294 - DNA, 601 bp, Human
agttcaagtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgastttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactccctcttcgagatgctgatttggaaaataactccatgatgaaacatgtcaagggagactgcctgtactccgtaatgcaga

SEQ ID NO: 79295 - DNA, 601 bp, Human
gctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctct

SEQ ID NO: 79296 - DNA, 601 bp, Human
cacccgggttctccctgtctataaggggaaaagacagggttcacaccaaggcctgtctggatccaaaacccatgctcataatcactaagttatactccctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatc

SEQ ID NO: 79297 - DNA, 601 bp, Human
gacttagtctcagaaggcagagggtgtcacttccactgcatctttggggaaggcagtcaccactgtatagtcctgagctcactgggattaaggggaagggacacagactccacctctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacctggccaacacaccatgccttcccagtctctggtgttactstctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccagtacccgtgaatgctacttcctccaaagagaattcctgggataacagagaatccattcatggctgccaggaggact

SEQ ID NO: 79298 - DNA, 601 bp, Human
tacttctcatccttcaggtctactgcaagtgtcacctggccaacacaccatgccttcccagtctctggtgttactgtctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaaccagctttgctggtttctattatagccctggtgtggcaaaggacactgtgtgactgtgagctcaggtcagcattgcgatcccttcaggcctctggcttgcaggttcctgtt

SEQ ID NO: 79299 - DNA, 601 bp, Human
gtccctgttgagtccctgtgcaccttcagaaccacatctagcaatagaaggcgctgcacggggaattctggaatgaataaaaacgcttggcagtaccgcatggcgagccagtacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccat

SEQ ID NO: 79300 - DNA, 601 bp, Human
ttaggcgtgccacgtactaggtggcttcagtcagcagaactgtattttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctatgtcttcaatgttcttcttataaggacaccagtccttggatttagagyccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgca

SEQ ID NO: 79301 - DNA, 601 bp, Human
agatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcytcatttccctttgttgcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagg

SEQ ID NO: 79302 - DNA, 601 bp, Human
tggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcttcatttccctttgtygcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatag

SEQ ID NO: 79303 - DNA, 601 bp, Human
tgaatggagagctctttctcggataccaaagctatttaatatttatcattgactaataatggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttactaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagcgagggcccagccccttttaagggcctagcgattagatcagtcccac

SEQ ID NO: 79304 - DNA, 601 bp, Human
atggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcatgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagcgagggcccagccccttttaagggcctagcgattagatcagtcccacttaggattgaatcccttttgattaatgcaaaaccaactgcgttcaggcctccatgaca

SEQ ID NO: 79305 - DNA, 601 bp, Human
acagatgttgaaactgagacttagaagcattatgcaccatgccaaaggccatggaaggacagagcttgggcatgctcccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacgccagtgcaattatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtga

SEQ ID NO: 79306 - DNA, 601 bp, Human
tactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagat

SEQ ID NO: 79307 - DNA, 601 bp, Human
atcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtgatgtgccaccatagccagctattttttttgcattttttagagatgagtttttgccgtgttgccgaggctggtctcaaactcctgggctcaagctattcacctgctttggcctcccaaagtgctgggattacaggcatgagccaccatgcccggcccccttttttaa

SEQ ID NO: 79308 - DNA, 601 bp, Human
aattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggctcaagctattcacctgctttggcctcccaaagtgctgggattacaggcatgagccaccatgcccggcccccttttttaaaaaacaaaaaaacaaaaaactcttttgtgttttagaaatggggtctcactatgttcttcaggctagtcttgaactcatggcctccagtgatcctcccgcctcagcctcctgagtcactggaatttcaggcatga

SEQ ID NO: 79309 - DNA, 601 bp, Human
tcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtgatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaactcttttgtgttttagaaatggggtctcactatgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagg

SEQ ID NO: 79310 - DNA, 601 bp, Human
tgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatt

SEQ ID NO: 79311 - DNA, 601 bp, Human
tcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcartttgaagatccacatatggctgagggctactctaatgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcc

SEQ ID NO: 79312 - DNA, 601 bp, Human
ctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcaatttgaagakccacatatggctgagggctactctaatgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaag

SEQ ID NO: 79313 - DNA, 601 bp, Human
tgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttctttctctttttctgtgtgctcttctaagagtaaaacgcatgtccccccatgaagtcactcaaagctcaggcgtgtgcaacagggac

SEQ ID NO: 79314 - DNA, 601 bp, Human
ataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttctttctctttttctgtgtgctcttctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgactgggtcccgggtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtg

SEQ ID NO: 79315 - DNA, 601 bp, Human
agtacagggatgtgtctgaccccaggagaactgccccgatccctatcttgtctctgctcagttctggtaactcttttatcttccctggagttatttttttcccttctttctttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgactgggtcccgkgtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctcc

SEQ ID NO: 79316 - DNA, 601 bp, Human
ttatttttttcccttctttctttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgactgggtcccgggtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcag

SEQ ID NO: 79317 - DNA, 601 bp, Human
ggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggaataagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttaagagttaacctgagtgtctgctgcatagtaggtgctcaataaactataacgtctttatttcttttccttccaatgagaagtcacttcctggagggaagccacctccaggaacagtcctggttcaactcatgaggag

SEQ ID NO: 79318 - DNA, 601 bp, Human
atttggatgtgtcgggggccacaggacactactgtgcatttgcctgtgatttgccattgggttggagtacttctcctgagtttctgcagtgttctaggtatggtcttaggccctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttaagagttaacctgagtgtctgctgcatagtaggtgctcaataaactataacgtctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctcct

SEQ ID NO: 79319 - DNA, 601 bp, Human
ttggagtacttctcctgagtttctgcagtgttctaggtatggtcttaggccctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttmagagttaacctgagtgtctgctgcatagtaggtgctcaataaactataacgtctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttattttt

SEQ ID NO: 79320 - DNA, 601 bp, Human
ctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttaagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttattttaattaaataatttatttttctgagacagactgtcgctctgtcgcca

SEQ ID NO: 79321 - DNA, 601 bp, Human
ttgcccacgagcagcaactcctgtttcttgtttttttccttttctttttcttttcttttgagacagagtctcgctccgtcgcctgggctggagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtg

SEQ ID NO: 79322 - DNA, 601 bp, Human
ggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacg

SEQ ID NO: 79323 - DNA, 601 bp, Human
acaaattacagattatccagaacaggtgggctgtacataaacaggctggtgggctggatttgtcctgtggactgtagtttgctgacatccaggctagatccttaatatacaatgaagtagtaaaacacatgtaaaagtaaaaagcaggcgaaatagaataaaatacacatttgcacaccacagtatccaaaaaggttatgtactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataa

SEQ ID NO: 79324 - DNA, 601 bp, Human
ggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacaactactacatgctagatctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaagg

SEQ ID NO: 79325 - DNA, 601 bp, Human
agctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcattaacatgccttatctgacatgtggcaataacttctgcctttcttatgtcatctgcatggttgcagtggatagtcactggacaattgatgaacamctactacatgctagatctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcg

SEQ ID NO: 79326 - DNA, 601 bp, Human
agctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcattaacatgccttatctgacatgtggcaataacttctgcctttcttatgtcatctgcatggttgcagtggatagtcactggacaattgatgaacaactactacatgctaratctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctct

SEQ ID NO: 79327 - DNA, 601 bp, Human
tccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaagggg

SEQ ID NO: 79328 - DNA, 601 bp, Human
taagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaagattagcgagatattgtctctactctcaagaaactcgctttctttgggaatcatcacctgtttttgtgtcacggaccccttgggcatttggtgccctttgcagaataatggttttgaatacataaaacgcacgggatcacagaggaaaccaatcatattaaaatacagttgtcaaaatattaactcatgggatctagtaa

SEQ ID NO: 79329 - DNA, 601 bp, Human
tttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcatagggtttggggaggattaaataagataatgtaaatagagtttagcgtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatata

SEQ ID NO: 79330 - DNA, 601 bp, Human
gagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcactttctggctttgtgacctttctgcaggttacttctctcccctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaataaaagaattactgttctccctttgcatttatgcattgcatgtctctgttgaattca

SEQ ID NO: 79331 - DNA, 601 bp, Human
ccggaactgaggtggcacatgtcagcggctttgctcagaagcacccagggatgatggaaaaggcaaccgaaagggctcagcttctgcagatagagtctgtgctttgcactttctggctttgtgacctttctgcaggttacttctctcccctgagcatcagtttactcagctgaaaaatgcatctgctaataatacctatggcatagggtttggggaggattaaataagataatgtaaatagagtttagcgtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaataaaagaattactgttctccctttgcatttatgcattgcatgtctctgttgaattcagagtgctttatagacctctgatcagcttccagcatcctcttggtatgagtt

SEQ ID NO: 79332 - DNA, 601 bp, Human
ctatggcatagggtttggggaggattaaataagataatgtaaatagagtttagcgtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagagga

SEQ ID NO: 79333 - DNA, 601 bp, Human
aagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatc

SEQ ID NO: 79334 - DNA, 601 bp, Human
aaggcaggaggatcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccattttacaccctgtttattgatactaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgtta

SEQ ID NO: 79335 - DNA, 601 bp, Human
agctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaacttttcattgcaaaatgaaaattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgttataagccaagctttgcaaaggtggaacaccttggagatacttatctcctccttactctacccaagtaatgactcatccttttatacagaatgtctcttttttgatttagatgtctttttt

SEQ ID NO: 79336 - DNA, 601 bp, Human
ccattttgtgtaagctatcctgggcctccctgcctcccattttacaccctgtttattgatactaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagt

SEQ ID NO: 79337 - DNA, 601 bp, Human
aacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccacgcccgactgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactg

SEQ ID NO: 79338 - DNA, 601 bp, Human
ttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttacccaggatggtctcgatctcctgacctcatgatccacctgccttggcctcccaaagtgctgggattacaggcgtgagccaccacgcccgrctgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttctt

SEQ ID NO: 79339 - DNA, 601 bp, Human
acttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggaga

SEQ ID NO: 79340 - DNA, 601 bp, Human
gaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagttttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatctgtgcaccagtaaagggttctgatgtgtgataaatttatttagctattactcatctgaagttatactattttaggatcttggggcagtgaggactttggaaatggaacaggatgctcctttaagttagggtaaaatgaagtctataaaaactgtttttctatatcctcctcctaccccacaaagaaagttagggtaatatattcttatataaaattgacatttttaactttaatgagaa

SEQ ID NO: 79341 - DNA, 601 bp, Human
caacaggataagcagaatcgattgatgaaggagggagcctacctctggaggccccaggctgggactttgggtacagatgcacaggagacctttgccccaccccgtcacggctgggcctactcagttccacgtctttgagttttcacgcggaaactggatgtttcttacatcctcagctgcaggcatggggaagagacgcacatcagccattaagaaaaaggtatgcagtctacatgcctcttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggactttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagatttt

SEQ ID NO: 79342 - DNA, 601 bp, Human
aagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccctggatttattggtctttggactctcccgctagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggac

SEQ ID NO: 79343 - DNA, 601 bp, Human
atggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaa

SEQ ID NO: 79344 - DNA, 601 bp, Human
gtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattg

SEQ ID NO: 79345 - DNA, 601 bp, Human
tatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgc

SEQ ID NO: 79346 - DNA, 601 bp, Human
tagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctc

SEQ ID NO: 79347 - DNA, 601 bp, Human
tttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgt

SEQ ID NO: 79348 - DNA, 601 bp, Human
ttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaat

SEQ ID NO: 79349 - DNA, 601 bp, Human
ataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatataatctatatattgatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtat

SEQ ID NO: 79350 - DNA, 601 bp, Human
gaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatataatctatatatagatatctatataatatatataatctatatatgatatatatatcttattatatattatatatatagatagatatctatatacagatatctrtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtatagataatttatatataaatatgtgtatatatatatttgttagggtaaaacaaagtctataaaaactgttttcctttgtcattgcccccac

SEQ ID NO: 79351 - DNA, 601 bp, Human
tatatataatatatagaaagatatataatctatatatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaayatatatattatatatatataaaatatatattatgtatagataatttatatataaatatgtgtatatatatatttgttagggtaaaacaaagtctataaaaactgttttcctttgtcattgcccccaccaaatatttatatatatgtatatacacatatgtatatatgtatgtatagagagtctattatatatattacatatacataatatatacataatatataatagactctataatatagactctaatatgtagtctatatattatattataatgtatgtaatatataatatattcta

SEQ ID NO: 79352 - DNA, 601 bp, Human
atatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattakgtatagataatttatatataaatatgtgtatatatatatttgttagggtaaaacaaagtctataaaaactgttttcctttgtcattgcccccaccaaatatttatatatatgtatatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatat

SEQ ID NO: 79353 - DNA, 601 bp, Human
atagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtatagataatttatatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatattatatatgggtttctatatattataataaacccatatataatatacataatagactatacacatatac

SEQ ID NO: 79354 - DNA, 601 bp, Human
agggtaaaacaaagtctataaaaactgttttcctttgtcattgcccccaccaaatatttatatatatgtatatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcct

SEQ ID NO: 79355 - DNA, 601 bp, Human
ttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacctatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggac

SEQ ID NO: 79356 - DNA, 601 bp, Human
taccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcaaccaccattctcccctactttgtctatgaattcgactactcttggtacctcatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttggaactgggtggcactgactggcccagccaaggggtcacgcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttata

SEQ ID NO: 79357 - DNA, 601 bp, Human
actgaaacgctgtacccacagaacactggctcctcatcacctccccaagcccagcccctggcaaccaccattctcccctactttgtctatgaattcgactactcttggtacctcatataagtggaatcacacagtgtgtgatgtgttcttttgtggctgacttatttatgatactggattctcagcatcatgggagttaggactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataa

SEQ ID NO: 79358 - DNA, 601 bp, Human
tatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaata

SEQ ID NO: 79359 - DNA, 601 bp, Human
tggattgtctcaaaggcattaatctttttggtatccaacatcttgaatgcttctgtgtcattttcctttctttttttttttcaaagcacttaattatttaaaaacaaaaatacttctctgatcagagcatacctgccgtgctcaaagcacttgcttacttggaatgccataaattacatgaaggaattattcattgtatcacgaaacataccttccagtctcccgagtagtgtattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcatttgaccgtcagtattttcatttttgcatgtgccactttaatttccctaggcaacactagctagtgg

SEQ ID NO: 79360 - DNA, 601 bp, Human
ccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgayctcaggtgtaccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctatcttttccgttcctccttccagcatactcagcacagtccacctctgtggtctctctgtggttttct

SEQ ID NO: 79361 - DNA, 601 bp, Human
ctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgatctcaggtgtwccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctatcttttccgttcctccttccagcatactcagcacagtccacctctgtggtctctctgtggttttctttctgttttc

SEQ ID NO: 79362 - DNA, 601 bp, Human
taatgtttgtatttttagtagggacggggtttcgccatgttggccaggctggtgtcaaactcctgatctcaggtgtaccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccactctgtcaaccatgccatggggcctactttttgccctgactcccaccagataatgcccatcagatggcacct

SEQ ID NO: 79363 - DNA, 601 bp, Human
ctcaagatcttagaaggccatgcctacattgccaccagcatcccttggctttttgcttggcttaagaatctatcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagctcctaaggaagtgccagagtca

SEQ ID NO: 79364 - DNA, 601 bp, Human
gaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgcca

SEQ ID NO: 79365 - DNA, 601 bp, Human
ttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcagctcacaccctgttggccctttgcaaatatttgtctttcctcatgcacgtggttattcccagaaagatccagtgaattgtctcctgaagataaaatacataaaagggcgtttcaaagtataaacagtgattttaatgaaaaataagaagaaaatgcttatgatacaacattaggtggaaaacgaaggaagaaaaattctgtgagtct

SEQ ID NO: 79366 - DNA, 601 bp, Human
tttttattttttttgagacagagtttctctcttgtcacacaggctggagtgcaatggtgcaatctcagctcactgcaatgtctgcctcccagattcaagcaattttcctgcctcaggctcccaagtagctgggattacaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttgggattcttaaatttaacatggataaactgaacttgatttcctgcattaaaaaaaattaaagaaatgaaagttctgactgttttattgtagctggggaatt

SEQ ID NO: 79367 - DNA, 601 bp, Human
tccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggattaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagtt

SEQ ID NO: 79368 - DNA, 601 bp, Human
ggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggyggtctgatacagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttccccc

SEQ ID NO: 79369 - DNA, 601 bp, Human
actctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggcggtctgatayagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccagg

SEQ ID NO: 79370 - DNA, 601 bp, Human
cacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggcggtctgatacagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctgagcaggattat

SEQ ID NO: 79371 - DNA, 601 bp, Human
tactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgtagaatgaggctaatgctagtgctcatttcatagagttgctacaataatcaatgagataatgtgcataaagatttacatacataataactgctcaataaagggtagatgttaaaattagcatcagc

SEQ ID NO: 79372 - DNA, 601 bp, Human
attcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaragacacaaattgtccttaccctcatggattcaccatctatttaaaggccacaaatacttgtgtgagaagcaagtcttaatagtctgaagtattttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgca

SEQ ID NO: 79373 - DNA, 601 bp, Human
tgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaaagacacaaattgtccttaccctcatggattcaccatstatttaaaggccacaaatacttgtgtgagaagcaagtcttaatagtctgaagtattttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgta

SEQ ID NO: 79374 - DNA, 601 bp, Human
caactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaaagacacaaattgtccttaccctcatggattcaccatctatttaaaggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaata

SEQ ID NO: 79375 - DNA, 601 bp, Human
cagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttgg

SEQ ID NO: 79376 - DNA, 601 bp, Human
agatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaac

SEQ ID NO: 79377 - DNA, 601 bp, Human
tgtctctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaacgagaaattacagccc

SEQ ID NO: 79378 - DNA, 601 bp, Human
ataagaagctgctgaggaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactgacccaaatcacacgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggg

SEQ ID NO: 79379 - DNA, 601 bp, Human
aaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaacgagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagac

SEQ ID NO: 79380 - DNA, 601 bp, Human
tctgccgcctttaggaaacgagatgaattgttaaacttcttgcactgagctttaccaggtgagctgacagttatcctctgcattcatcaatataagccccataaaaggcaaagtggttgaggagaaacgagaaattacagcccagattagcagccttgagtgctccttgtgaacacaagacactgacccaaatcacacgtcacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacctaagtgtgcaatgctttaaatcagtaagtttgtttttcattaacataaaatccaaaacaggtgctgtgatcagcaagccgctgtcctccaagtggtaattcagg

SEQ ID NO: 79381 - DNA, 601 bp, Human
acgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtccacattagtgaac

SEQ ID NO: 79382 - DNA, 601 bp, Human
tcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgagg

SEQ ID NO: 79383 - DNA, 601 bp, Human
tctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtgrtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatca

SEQ ID NO: 79384 - DNA, 601 bp, Human
tttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtggtagactggattaagaaaatgtggcctttgcctcttttaaaaagttctaagttgctagccagtcggracaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatcatattgcttaagaagtggatggcaagaagataattactaatatgtctgcaattgatctgaaattgac

SEQ ID NO: 79385 - DNA, 601 bp, Human
ttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatcatattgcttaagaagtggatggcaagaagataattactaatatgtctgcaattgatctgaaattgacacagttgatctaactgattcatggggaccctgggagtatgtttgtgtatttgggggttgggatgg

SEQ ID NO: 79386 - DNA, 601 bp, Human
aatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagyatttctaacaatcatattgcttaagaagtggatggcaagaagataattactaatatgtctgcaattgatctgaaattgacacagttgatctaactgattcatggggaccctgggagtatgtttgtgtatttgggggttgggatgggggggtgggtggagggtcagagaggtggcaaaagcaggtgggaacagggttacagagcaaagtaattagatgccctttagatgctcttagttaaagaccatgcaaaaaggatgaaatcttttgatcatgttcttcacaatattagaggtaaaaca

SEQ ID NO: 79387 - DNA, 601 bp, Human
taagaagtggatggcaagaagataattactaatatgtctgcaattgatctgaaattgacacagttgatctaactgattcatggggaccctgggagtatgtttgtgtatttgggggttgggatgggggggtgggtggagggtcagagaggtggcaaaagcaggtgggaacagggttacagagcaaagtaattagatgccctttagatgctcttagttaaagaccatgcaaaaaggatgaaatcttttgatcatgttcttcacaatattagaggtaaaacatgaactcaacgcttttaggaaraaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtagga

SEQ ID NO: 79388 - DNA, 601 bp, Human
agtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagtaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggct

SEQ ID NO: 79389 - DNA, 601 bp, Human
ctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggtaggaagagtttgccagcccgaaaactccagtaagcaaacagctttatagtaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattatgagctgcatgtaccaatatatagctctttacccacaaaagcatgctgcaacggggaatctttcagagataataaaaggattcatcaagtgtctatacgatagctacttaaatcgctattgttttagttaggcccgcaaaa

SEQ ID NO: 79390 - DNA, 601 bp, Human
gctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaac

SEQ ID NO: 79391 - DNA, 601 bp, Human
aatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatcttctctttatggatttccctttggaagcagggataagaagagggaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacac

SEQ ID NO: 79392 - DNA, 601 bp, Human
attatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcattagagtctttctgtaaagaccattattatttctgttatatttcctgtggctgagctgagccgcacttggagatttgatccattttaactctctcatt

SEQ ID NO: 79393 - DNA, 601 bp, Human
aggttctctaacacactgagagtcgtttggagggtagtgtgaagtggcgttatagttctccttttaatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcktgtgataggttcaattctcaggctccttctcattagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaatagg

SEQ ID NO: 79394 - DNA, 601 bp, Human
ggtagtgtgaagtggcgttatagttctccttttaatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcrttagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaattta

SEQ ID NO: 79395 - DNA, 601 bp, Human
tagtgtgaagtggcgttatagttctccttttaatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcatyagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttaga

SEQ ID NO: 79396 - DNA, 601 bp, Human
taatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcattagagtctttctgtaaagaccattattattkctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatc

SEQ ID NO: 79397 - DNA, 601 bp, Human
ggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagrctccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaa

SEQ ID NO: 79398 - DNA, 601 bp, Human
gtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagactccatttactcacctgttgtatcatctgaattatttccatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtga

SEQ ID NO: 79399 - DNA, 601 bp, Human
caagttccgctgagactccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaamaacaaacaaacaaaaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttac

SEQ ID NO: 79400 - DNA, 601 bp, Human
gttccgctgagactccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaamaaacaaacaaaaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccat

SEQ ID NO: 79401 - DNA, 601 bp, Human
actccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaacaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagg

SEQ ID NO: 79402 - DNA, 601 bp, Human
actcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatga

SEQ ID NO: 79403 - DNA, 601 bp, Human
caaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctgkatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaa

SEQ ID NO: 79404 - DNA, 601 bp, Human
tagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatayaggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaag

SEQ ID NO: 79405 - DNA, 601 bp, Human
tggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatawtagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgt

SEQ ID NO: 79406 - DNA, 601 bp, Human
ctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatattagtcatgatatakggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgcta

SEQ ID NO: 79407 - DNA, 601 bp, Human
ttttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatattagtcatgatatagggaattgaaaagacattcacrttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttaca

SEQ ID NO: 79408 - DNA, 601 bp, Human
aatgtagtgagagaaggaaggaagagagagagggaagaaggggaaaaagagggatggaaaggaggaaggaaggaaaggagggaggaggcaagtatattagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggag

SEQ ID NO: 79409 - DNA, 601 bp, Human
aaggaaggaaaggagggaggaggcaagtatattagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgaaaatgacattttaaattaatgt

SEQ ID NO: 79410 - DNA, 601 bp, Human
taaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgaytattatacagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaa

SEQ ID NO: 79411 - DNA, 601 bp, Human
tgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatasagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaa

SEQ ID NO: 79412 - DNA, 601 bp, Human
tatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctcctwttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcac

SEQ ID NO: 79413 - DNA, 601 bp, Human
taacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgamaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaata

SEQ ID NO: 79414 - DNA, 601 bp, Human
atgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaattt

SEQ ID NO: 79415 - DNA, 601 bp, Human
accctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatctccctctccagtgaggcttttggccactggccgttaattggtaaggttcttgaaaactgaagtgatggtatcagcatggatgc

SEQ ID NO: 79416 - DNA, 601 bp, Human
taactgaaaccaaattagctcaaactggttatatttctgggtacaaaccaggtgtatagttaatccattgttgtttctgtgtcgaccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaaga

SEQ ID NO: 79417 - DNA, 601 bp, Human
cacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctmaaatgttaggaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatac

SEQ ID NO: 79418 - DNA, 601 bp, Human
gcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctaaaatgttargaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaac

SEQ ID NO: 79419 - DNA, 601 bp, Human
atcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccccttgaacagtgcttg

SEQ ID NO: 79420 - DNA, 601 bp, Human
ctgcagaggaatcgagtgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaat

SEQ ID NO: 79421 - DNA, 601 bp, Human
gccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctggcgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaa

SEQ ID NO: 79422 - DNA, 601 bp, Human
aggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttagatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgc

SEQ ID NO: 79423 - DNA, 601 bp, Human
ctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcac

SEQ ID NO: 79424 - DNA, 601 bp, Human
gcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaaaaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtaggga

SEQ ID NO: 79425 - DNA, 601 bp, Human
tgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctaggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaa

SEQ ID NO: 79426 - DNA, 601 bp, Human
atgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgtgttttccagaaaccaactgggaagggccctaa

SEQ ID NO: 79427 - DNA, 601 bp, Human
tgagaagtttagttgccactttcagcttagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattatttctgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattataga

SEQ ID NO: 79428 - DNA, 601 bp, Human
ttaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtagaaggaacctggatttctatttttttaaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcata

SEQ ID NO: 79429 - DNA, 601 bp, Human
taatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtccgagcaggcaactccgaccccaagttggagctgtgtgttgaagatagaagagcaaatatgtrgaaggaacctggatttctatttttttaaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacc

SEQ ID NO: 79430 - DNA, 601 bp, Human
tgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtccgagcaggcaactccgaccccaagttggagctgtgtgttgaagatagaagagcaaatatgtagaaggaacctggatttctatttttttwaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacctgggattttggggacaacagtgaccat

SEQ ID NO: 79431 - DNA, 601 bp, Human
gaaatgtcactagtccttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacattcga

SEQ ID NO: 79432 - DNA, 601 bp, Human
atctccctttataagctaggaatactaagaacctaagagtctccatgaggattagatgaggtaatgtttgtaaagaatctgagatatagtaagttgatcagcatatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgt

SEQ ID NO: 79433 - DNA, 601 bp, Human
atactaagaacctaagagtctccatgaggattagatgaggtaatgtttgtaaagaatctgagatatagtaagttgatcagcatatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttc

SEQ ID NO: 79434 - DNA, 601 bp, Human
tctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaaacatattaagtta

SEQ ID NO: 79435 - DNA, 601 bp, Human
tttttttcttttgtttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaacgttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaat

SEQ ID NO: 79436 - DNA, 601 bp, Human
tgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaaacatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtc

SEQ ID NO: 79437 - DNA, 601 bp, Human
caaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagccccccacttaggtgttatgtgactgtggtcgggttattggtaacatcttcttgctcagcttcctgacctgcagaatgggaataagaatacct

SEQ ID NO: 79438 - DNA, 601 bp, Human
tcatgagaattttctgaagctattgtgaatctatggaagactcaaggtagtatctttttcacagcattcaaaaaaatgctgctggctccttggcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacatagggttataatgaagatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtat

SEQ ID NO: 79439 - DNA, 601 bp, Human
gtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagccccccacttaggtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaa

SEQ ID NO: 79440 - DNA, 601 bp, Human
taattgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttamgataccacgcactgctttaggcactgggaatatagcaggatatacaaaacagaaaaatcatggccctcatggattattggttgtgagtaataggaacctttcaatctaacttaggaaaaaacgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctgg

SEQ ID NO: 79441 - DNA, 601 bp, Human
tgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttacgatrccacgcactgctttaggcactgggaatatagcaggatatacaaaacagaaaaatcatggccctcatggattattggttgtgagtaataggaacctttcaatctaacttaggaaaaaacgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctggttca

SEQ ID NO: 79442 - DNA, 601 bp, Human
tacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttacgataccacgcactgctttaggcactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctggttcaattattctcttgccacgaatcagctatttgtattcctctgtgcacgtcgcagaagatcaggaatttgcacattatagtcacaaccatacctagaaccaaattgcctaacactgaatcc

SEQ ID NO: 79443 - DNA, 601 bp, Human
tttatttcttacgataccacgcactgctttaggcactgggaatatagcaggatatacaaaacagaaaaatcatggccctcatggattattggttgtgagtaataggaacctttcaatctaacttaggaaaaaacgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacaaatcagctgtttatactcctctttgcacgttgcagaagatcaggaatttgcacattatagccacaaccatacccagaaccagattgtctaacactgaatctcgaatccaaattcctggat

SEQ ID NO: 79444 - DNA, 601 bp, Human
ccagagaatcccgtggaatcccacagtgacacagccaagccttgggaggggtgacactagcgatagagacagaaacccacacaggagtccttttctctgtctctcatctctgcttttctctgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatctcgaatccaaattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccggg

SEQ ID NO: 79445 - DNA, 601 bp, Human
gtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagcggagtt

SEQ ID NO: 79446 - DNA, 601 bp, Human
tggtttatgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgagagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcct

SEQ ID NO: 79447 - DNA, 601 bp, Human
aactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagcggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcctatacctatagttacaggccatttaagatccacagtctgctcttttagcttctgccagcacatttgga

SEQ ID NO: 79448 - DNA, 601 bp, Human
ccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccag

SEQ ID NO: 79449 - DNA, 601 bp, Human
cttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggtt

SEQ ID NO: 79450 - DNA, 601 bp, Human
tcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcrcagtgactccttgttagggtttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctccc

SEQ ID NO: 79451 - DNA, 601 bp, Human
gagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcacagtgactccttgttagggwttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggc

SEQ ID NO: 79452 - DNA, 601 bp, Human
ggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgat

SEQ ID NO: 79453 - DNA, 601 bp, Human
cacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtggcactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgag

SEQ ID NO: 79454 - DNA, 601 bp, Human
acacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgaga

SEQ ID NO: 79455 - DNA, 601 bp, Human
catatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactacca

SEQ ID NO: 79456 - DNA, 601 bp, Human
ttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatacctagtgatacagcagtgaacaaaggaaatccctgccctcagggagctttcattctact

SEQ ID NO: 79457 - DNA, 601 bp, Human
tgtttctttgaagttttatgaccaacaattaatgttactggaaggcccataaaaagggctgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcattctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgcc

SEQ ID NO: 79458 - DNA, 601 bp, Human
tctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaa

SEQ ID NO: 79459 - DNA, 601 bp, Human
accaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaag

SEQ ID NO: 79460 - DNA, 601 bp, Human
atattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctcca

SEQ ID NO: 79461 - DNA, 601 bp, Human
tggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcattt

SEQ ID NO: 79462 - DNA, 601 bp, Human
aaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttc

SEQ ID NO: 79463 - DNA, 601 bp, Human
ggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtg

SEQ ID NO: 79464 - DNA, 601 bp, Human
ttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggac

SEQ ID NO: 79465 - DNA, 601 bp, Human
aagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcggg

SEQ ID NO: 79466 - DNA, 601 bp, Human
gactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtct

SEQ ID NO: 79467 - DNA, 601 bp, Human
caaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatct

SEQ ID NO: 79468 - DNA, 601 bp, Human
tgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtagga

SEQ ID NO: 79469 - DNA, 601 bp, Human
tctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatg

SEQ ID NO: 79470 - DNA, 601 bp, Human
tagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgygtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtc

SEQ ID NO: 79471 - DNA, 601 bp, Human
ttatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgtgtacttgcaatccccacttgascaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtcctgtagccccagagcctctcga

SEQ ID NO: 79472 - DNA, 601 bp, Human
acggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgtgtacttgcaatccccacttgaccaaagstgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtcctgtagccccagagcctctcgatgacct

SEQ ID NO: 79473 - DNA, 601 bp, Human
gtcatttggagacctacagaaaaaaatgccaagaatgcacgctgggaattcattaagagatttcaggacgttgaaatactgtgtgtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttyacaaaagtggaaaatgtgatatgacagactggaaccagcacagggacgcagcccctcacctgctgggggtctttgggtgggtcctgtagccccagagcctctcgatgacctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatca

SEQ ID NO: 79474 - DNA, 601 bp, Human
atgcacgctgggaattcattaagagatttcaggacgttgaaatactgtgtgtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggawccagcacagggacgcagcccctcacctgctgggggtctttgggtgggtcctgtagccccagagcctctcgatgacctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccat

SEQ ID NO: 79475 - DNA, 601 bp, Human
aggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacc

SEQ ID NO: 79476 - DNA, 601 bp, Human
aagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgca

SEQ ID NO: 79477 - DNA, 601 bp, Human
ttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctccc

SEQ ID NO: 79478 - DNA, 601 bp, Human
ttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactg

SEQ ID NO: 79479 - DNA, 601 bp, Human
tttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgc

SEQ ID NO: 79480 - DNA, 601 bp, Human
atcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggag

SEQ ID NO: 79481 - DNA, 601 bp, Human
tatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaa

SEQ ID NO: 79482 - DNA, 601 bp, Human
ggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggt

SEQ ID NO: 79483 - DNA, 601 bp, Human
ggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacggga

SEQ ID NO: 79484 - DNA, 601 bp, Human
gaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacaycctgccgttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggcc

SEQ ID NO: 79485 - DNA, 601 bp, Human
ctaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacatcctgccrttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctg

SEQ ID NO: 79486 - DNA, 601 bp, Human
cgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctacttacgtgctacggatttaatatagcgtcaggctcctctaggtacaataaaataccaagttaagagcattaattccttacaaccctgatgggtcccagctgtgcacacgcatgtagggtgtgagggtgtgtgctcagcgggcacaggtgctgacggggctgttccacctcggagcgcgtgggccgggaacacagctgtttc

SEQ ID NO: 79487 - DNA, 601 bp, Human
atgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattcgttctcagcatcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagcattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctga

SEQ ID NO: 79488 - DNA, 601 bp, Human
ccacaattgctgggagtctgagatagattcaattgggaaaactaggttagtgccagataaggtccattactctttaaaagtggccactcatccctaataataaataaaccaaacattgggatattaaaacaattcgttctcagcatcagaaaagaggtcgtgtgtgtgtttgtgtttttttaatatcccatccagcccccagccccagtaaccctaagattgaacaaaaccctacttacgtgctacggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcag

SEQ ID NO: 79489 - DNA, 601 bp, Human
attccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttc

SEQ ID NO: 79490 - DNA, 601 bp, Human
gctaagctgaatggtgaaaggcccagatttagttctcattgtaggaaaaagggccagaataccttgcccatttttgccttgggaagtgagctcaatgaaatacatcttcatatgcccattttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggc

SEQ ID NO: 79491 - DNA, 601 bp, Human
tgaacgcaaggtgaggatgggccttctccgccttcaaaagttgctgccttccaaggggaaaaggtctggtcttgtaatttctggtctgtgcgtgctgtataaggaagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgagggcagctggggagtgaatctgtcgtttgttgaggctctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaa

SEQ ID NO: 79492 - DNA, 601 bp, Human
aagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggcccataaaatactgcacatcttggcatcttacctataaaaataatgcagatacattcgtaactccccaggttttcgggagtggaaatgagggcagytggggagtgaatctgtcgtttgttgaggctctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaaatagtttgaccccaaggctccaggctttttccctatttctttctcacccacagccaattgcaatctggaccctttacctgtcagctgtaggaacatgaaataat

SEQ ID NO: 79493 - DNA, 601 bp, Human
gtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggcccataaaatactgcacatcttggcatcttacctataaaaataatgcagatacattcgtaactccccaggttttcgggagtggaaatgagggcagctggggagtgaatctgtcgtttgttgagrctctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaa

SEQ ID NO: 79494 - DNA, 601 bp, Human
atctaagtttagacgccctcctaggattaccaacgtaggcgtgatcaggcccataaaatactgcacatcttggcatcttacctataaaaataatgcagatacattcgtaactccccaggttttcgggagtggaaatgagggcagctggggagtgaatctgtcgtttgttgaggctctttttcctgcttgccagacactgatctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaac

SEQ ID NO: 79495 - DNA, 601 bp, Human
gcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttacacccgaagtgcattccatggccctgtcccag

SEQ ID NO: 79496 - DNA, 601 bp, Human
aaggaagacagggcaggagggtggtgtggcacaaaggcggctctgtctgacctgtcacgttaggactgagttcattcttgttcagattcagcatcttttgttacacccgaagtgcattccatggccctgtcccagccatagaaagaaatgcctttatttttaagcgagacttcttgtggaatgatgaatatgttcagggaggctgttggtggcaagaaaagaagggtgatgggttgggcttatattgtttagtggagcaaaagagatgtgaaacatttgtgtcttaaagtgttttggtcargagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcaggctgaagaaccaagctctgagagagttaatgattttctccagatcattcacattcatttctgttacacagctgggattataatccatgcctgtctgactctgaaacctattttcccatttttt

SEQ ID NO: 79497 - DNA, 601 bp, Human
ggaatgatgaatatgttcagggaggctgttggtggcaagaaaagaagggtgatgggttgggcttatattgtttagtggagcaaaagagatgtgaaacatttgtgtcttaaagtgttttggtcaagagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccagg

SEQ ID NO: 79498 - DNA, 601 bp, Human
catagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgc

SEQ ID NO: 79499 - DNA, 601 bp, Human
atatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaat

SEQ ID NO: 79500 - DNA, 601 bp, Human
atgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgca

SEQ ID NO: 79501 - DNA, 601 bp, Human
gctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatggagcaggggagatgctgatgatttggttacccccttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgat

SEQ ID NO: 79502 - DNA, 601 bp, Human
tagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacgtgacagttacgcaaaggcctggtctgatagaggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaa

SEQ ID NO: 79503 - DNA, 601 bp, Human
tttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcagggcctaggattggaaaacctccaac

SEQ ID NO: 79504 - DNA, 601 bp, Human
ttgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcaggrcctaggattggaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatgg

SEQ ID NO: 79505 - DNA, 601 bp, Human
tgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcagggcctaggattgsaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattcc

SEQ ID NO: 79506 - DNA, 601 bp, Human
catgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgt

SEQ ID NO: 79507 - DNA, 601 bp, Human
atttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacgtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaat

SEQ ID NO: 79508 - DNA, 601 bp, Human
agtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgattaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatg

SEQ ID NO: 79509 - DNA, 601 bp, Human
taatttctatataaagtgcttagcatagtgcctgccacttagacctcaaaatatattgttttcattggataattaaatataaaataacatacagcatgatgattaatacaactaataaatagtgcattagtattataggcacaaaagacagtatgaagtacagcacagatcatgaggagggtagggtcagttctacgtaaaaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctact

SEQ ID NO: 79510 - DNA, 601 bp, Human
gttctacgtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccaaccgaagagaccactgcattgttggccataagtgaaactagtgagatgtgtgggatatcataaaaagaacattgacataatccttttttggatgaagttatatcacaaccagaacacacaat

SEQ ID NO: 79511 - DNA, 601 bp, Human
ctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccaaccgaagagaccactgcattgttggccataagtgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagg

SEQ ID NO: 79512 - DNA, 601 bp, Human
cctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccarccgaagagaccactgcattgttggccataagtgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctccctt

SEQ ID NO: 79513 - DNA, 601 bp, Human
aattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccaaccgaagagaccactgcattgttggccataartgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacaca

SEQ ID NO: 79514 - DNA, 601 bp, Human
tctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggacatgggtgatcaagcagcagtatatctctttactccttgtattagtccattttcacactgc

SEQ ID NO: 79515 - DNA, 601 bp, Human
ggagggaaaaaaaatgttgtttgtgttcatttatggaaattagatctatcacatactcttatgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccctagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccat

SEQ ID NO: 79516 - DNA, 601 bp, Human
taagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggacatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtgggga

SEQ ID NO: 79517 - DNA, 601 bp, Human
aagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagrctttgatttcaggcaagattttgttaggtcccagtattggaacttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattgggaggtagtcttttcaggaatattctgagtttgtttcttgatctcgatagcagcaacctttccatttgctctctgtctggtttctctgtgtctctc

SEQ ID NO: 79518 - DNA, 601 bp, Human
ttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagactttgatttcaggcaagattttgttaggtcccagtattggracttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattgggaggtagtcttttcaggaatattctgagtttgtttcttgatctcgatagcagcaacctttccatttgctctctgtctggtttctctgtgtctctctttttccctcaaacatcgcttttctttttttaaaacaagaa

SEQ ID NO: 79519 - DNA, 601 bp, Human
taacggggaacccaatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctrctgtccttgccggtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagt

SEQ ID NO: 79520 - DNA, 601 bp, Human
caatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctgctgtccttgccsgtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaa

SEQ ID NO: 79521 - DNA, 601 bp, Human
ggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaaga

SEQ ID NO: 79522 - DNA, 601 bp, Human
tttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaatt

SEQ ID NO: 79523 - DNA, 601 bp, Human
caaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagctagtcaacgtccaactgccaatgttgcctgaacaggaaatatttatacctgaaagcgtccaggtgagagtcaggaaagccatgaaggtgcaactggcatactgatgtc

SEQ ID NO: 79524 - DNA, 601 bp, Human
tgggtagatttttgtacttttattgaccattcacatttcttcttttctgaactgcctttccatattctcggtccagctttctataagattgctctcatttactggtgagagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagytagtcaacgtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagaga

SEQ ID NO: 79525 - DNA, 601 bp, Human
ttttgtacttttattgaccattcacatttcttcttttctgaactgcctttccatattctcggtccagctttctataagattgctctcatttactggtgagagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagctagtcaacrtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggatttt

SEQ ID NO: 79526 - DNA, 601 bp, Human
ggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaa

SEQ ID NO: 79527 - DNA, 601 bp, Human
tcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggtccttgatcatttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatga

SEQ ID NO: 79528 - DNA, 601 bp, Human
aaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatactgttcaaccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctc

SEQ ID NO: 79529 - DNA, 601 bp, Human
atgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttgcagtcacagcagagatgcaggcccacagtagggactcaccagatgtggcagggtgagggaattgtccatagatgccttaaagatatgctatc

SEQ ID NO: 79530 - DNA, 601 bp, Human
actgcctcactcctgtggccccactgtgccatagacaggttagagaacatgggccctggcatcagacctggcaggcagtcttgattaggcccgttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcagtgcagagtcttcccccatccacacatataactccctttagtattgatgacctttctctcctgaaatattacagaaactgccctgaacgaagatagatggtcccccctcagcgttcacacatggttccgtct

SEQ ID NO: 79531 - DNA, 601 bp, Human
gaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaa

SEQ ID NO: 79532 - DNA, 601 bp, Human
gcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtga

SEQ ID NO: 79533 - DNA, 601 bp, Human
actttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggccca

SEQ ID NO: 79534 - DNA, 601 bp, Human
caattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgtttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaac

SEQ ID NO: 79535 - DNA, 601 bp, Human
acgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtmtttcttgaattttaactgtgcctgaagatcaatcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgt

SEQ ID NO: 79536 - DNA, 601 bp, Human
tggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtatttcttgaattttaactgtgcctgaagatcartcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactca

SEQ ID NO: 79537 - DNA, 601 bp, Human
cttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttc

SEQ ID NO: 79538 - DNA, 601 bp, Human
cacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttatttacagttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaag

SEQ ID NO: 79539 - DNA, 601 bp, Human
agagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccctacttttgactttataatattaagttcgttcatatctctcttagattcttatataaattttattgacctaatgttctgtacagtagtccttawttacagttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggcta

SEQ ID NO: 79540 - DNA, 601 bp, Human
tgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccctacttttgactttataatattaagttcgttcatatctctcttagattcttatataaattttattgacctaatgttctgtacagtagtccttatttacagttttggtttccaaggtttcagttatacattgtcamctgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtacatacatttgcctgtaagtgagcgcgttcttggatt

SEQ ID NO: 79541 - DNA, 601 bp, Human
gcctcctgctagttccttttctactctatttcagcttcctgtttgtaacatgatttaagcactaagctattgaattttggagtgcattaaaaaaaatatcgagtggaaaaaggaatatttcttagggaggaaaaaccctacttttgactttataatattaagttcgttcatatctctcttagattcttatataaattttattgacctaatgttctgtacagtagtccttatttacagttttggtttccaaggtttcagttatacattgtcaactgtggtacaaatatattacttacaataygatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtacatacatttgcctgtaagtgagcgcgttcttggattttgttgaatggtgccactgattatgggtc

SEQ ID NO: 79542 - DNA, 601 bp, Human
ttttattgacctaatgttctgtacagtagtccttatttacagttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggwcttggagtatatcccctgtgcagaagcggaggctactgtacatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaa

SEQ ID NO: 79543 - DNA, 601 bp, Human
gttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtayatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaag

SEQ ID NO: 79544 - DNA, 601 bp, Human
agaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaaccttcatttcctctcccacacaggataaaataaggataataacagccattttagagttcgtattaatatttaagtgggagaatgcagccagtaccctgagaattaaggttcat

SEQ ID NO: 79545 - DNA, 601 bp, Human
aatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgtcaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatg

SEQ ID NO: 79546 - DNA, 601 bp, Human
ctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtgggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgatt

SEQ ID NO: 79547 - DNA, 601 bp, Human
acaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtcatgtcatatgcaaatagagaattttatttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttt

SEQ ID NO: 79548 - DNA, 601 bp, Human
ttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaat

SEQ ID NO: 79549 - DNA, 601 bp, Human
ggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcytttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgatttt

SEQ ID NO: 79550 - DNA, 601 bp, Human
atggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttrtaatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctt

SEQ ID NO: 79551 - DNA, 601 bp, Human
ttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatawgattttcctttagctttttgatatggtggactatattgattttaaatattgaaccagccttgaagacctggaataaatcccacttggtcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccacca

SEQ ID NO: 79552 - DNA, 601 bp, Human
gccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctttagctttttgrtatggtggactatattgattttaaatattgaaccagccttgaagacctggaataaatcccacttggtcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgca

SEQ ID NO: 79553 - DNA, 601 bp, Human
gaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctttagctttttgatatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgta

SEQ ID NO: 79554 - DNA, 601 bp, Human
atatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctac

SEQ ID NO: 79555 - DNA, 601 bp, Human
tttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacct

SEQ ID NO: 79556 - DNA, 601 bp, Human
acctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacaagggatttcacctctctgactcatgcatcaggaacttggagataaagccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacctccagtttttctggagagattagattagaaattcatatatttttaaatattaaatcatccctttttcttgagatggtgtcacgtcgttgcccaggccaccgtttatgttgtccaggccaccctggaactcctggactcaagtgactt

SEQ ID NO: 79557 - DNA, 601 bp, Human
tgccttaatttttccagttgaggataattcacactaaacaagggatttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgartgttgccacgtggaaattagctataaacttgccagaacctccagtttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagt

SEQ ID NO: 79558 - DNA, 601 bp, Human
atttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacctccartttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagtgagccaaataaaatacatctgcagtccagattcaacctgcaggc

SEQ ID NO: 79559 - DNA, 601 bp, Human
cgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgg

SEQ ID NO: 79560 - DNA, 601 bp, Human
tctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttattctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagagga

SEQ ID NO: 79561 - DNA, 601 bp, Human
cttaaacagccagctattctgatcatttgaaatctggaacattctttcctacggtggttgacttttcactgcctttgaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatg

SEQ ID NO: 79562 - DNA, 601 bp, Human
cctttgaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggygacagagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatggcaagaaaaaccatggcctccagccccagtgttgaagttttgacgctaatgtgatgataattctcttttct

SEQ ID NO: 79563 - DNA, 601 bp, Human
gaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacaragctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgac

SEQ ID NO: 79564 - DNA, 601 bp, Human
cctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgactggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaa

SEQ ID NO: 79565 - DNA, 601 bp, Human
gagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgct

SEQ ID NO: 79566 - DNA, 601 bp, Human
ctagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccggga

SEQ ID NO: 79567 - DNA, 601 bp, Human
aactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgg

SEQ ID NO: 79568 - DNA, 601 bp, Human
caaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaayacaaggaaggaagagaatgcaggcagctcaaaagagccgggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagact

SEQ ID NO: 79569 - DNA, 601 bp, Human
ccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaatacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatga

SEQ ID NO: 79570 - DNA, 601 bp, Human
agattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttstggaaattcggactgtggattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttggggggggttttttgttgttgttgtttagctgtttatgggtaggagaatgcgtgctcttttagggacatctcttc

SEQ ID NO: 79571 - DNA, 601 bp, Human
ttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttgtggaaattcggactgtgrattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttggggggggttttttgttgttgttgtttagctgtttatgggtaggagaatgcgtgctcttttagggacatctcttcaaataagaacaggttgta

SEQ ID NO: 79572 - DNA, 601 bp, Human
ctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagkatttgtgtaagtgtcctctgccctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaat

SEQ ID NO: 79573 - DNA, 601 bp, Human
cctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccaytcttttctgaagtgatggggatattcgatggcaattttgtgttttcttcacttggaaaaactaaaaagtttgcaacatttaaaaaaaatacaacccttatgctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttg

SEQ ID NO: 79574 - DNA, 601 bp, Human
ctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccacwcttttctgaagtgatggggatattcgatggcaattttgtgttttcttcacttggaaaaactaaaaagtttgcaacatttaaaaaaaatacaacccttatgctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttga

SEQ ID NO: 79575 - DNA, 601 bp, Human
cagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccactcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctc

SEQ ID NO: 79576 - DNA, 601 bp, Human
ttgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttcta

SEQ ID NO: 79577 - DNA, 601 bp, Human
acagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatga

SEQ ID NO: 79578 - DNA, 601 bp, Human
gtagaaatcacttttagatcgtagaccataaaaaaacagcaggaaaaactacatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcata

SEQ ID NO: 79579 - DNA, 601 bp, Human
acatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcataggcccatctgttactactaacagtgctaatgtgattgtctgtaggtctagcaattggaggttgttcgtttctttgaga

SEQ ID NO: 79580 - DNA, 601 bp, Human
gcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcataggcccatctgttactactaacagtgctaatgtgattgtctgtaggtctagcaattggaggttgttcgtttctttgagacaaggtctcactctgttgcccaggctg

SEQ ID NO: 79581 - DNA, 601 bp, Human
agtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcct

SEQ ID NO: 79582 - DNA, 601 bp, Human
taggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggg

SEQ ID NO: 79583 - DNA, 601 bp, Human
gcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgct

SEQ ID NO: 79584 - DNA, 601 bp, Human
gcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaag

SEQ ID NO: 79585 - DNA, 601 bp, Human
aaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacatctccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgt

SEQ ID NO: 79586 - DNA, 601 bp, Human
aattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgttt

SEQ ID NO: 79587 - DNA, 601 bp, Human
ccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgta

SEQ ID NO: 79588 - DNA, 601 bp, Human
actccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcayttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatatgtctgtgtgtacatatatgtatatgttctgtgtatatgtagacatgtatagatgcatgtgtgtacgtatacacgcacacatacataaattgtgtacatacacatatacatatacacatacaat

SEQ ID NO: 79589 - DNA, 601 bp, Human
agccgatcataggactgctctaaggattaaatacaatgatgtaacctacttgaaagtgtcatataaattctgaggtgaagtggaggcattatggatgcattttattttgttttattttatttcatttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacct

SEQ ID NO: 79590 - DNA, 601 bp, Human
ggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcagtccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacaga

SEQ ID NO: 79591 - DNA, 601 bp, Human
gttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcctgttgctctgtaattcatctcagcaaccatctttcccatctctgggaagagaatgttgtcccccagaaaaagtccttatggatagatttagttattgcttatggtttag

SEQ ID NO: 79592 - DNA, 601 bp, Human
acaataaagatcaggccttgggagatgcaaacagtttgcccttggaccatgtcttctgctttcatccttatgctctcaacagatcatgccaaggtcctgtgttcaccgccttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggag

SEQ ID NO: 79593 - DNA, 601 bp, Human
aaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagt

SEQ ID NO: 79594 - DNA, 601 bp, Human
aatacacacacaaacacaaaccaggcaaacccacacaccacagagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaat

SEQ ID NO: 79595 - DNA, 601 bp, Human
gaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaatagaatcagagcaaattcagcatagacctccttgggatg

SEQ ID NO: 79596 - DNA, 601 bp, Human
atctccctggacatgaacttttgtagaagtagttacaatgctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaayagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatgatttcttatttgactctgtcctgtttactctgtcagggtgaaaagcacaggccaagctcggctagtcaaagcattactttgt

SEQ ID NO: 79597 - DNA, 601 bp, Human
agtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaatagaatcagagcaaattcagcatagacctccttgggatgtttwttctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaatta

SEQ ID NO: 79598 - DNA, 601 bp, Human
ttagagccagacatggaatcctttcttatgattaatgcagctaaatttcccactgcagccggtagcatattgcttcataaatgtctataaaaaaatacgaaaaatagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaastagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcc

SEQ ID NO: 79599 - DNA, 601 bp, Human
ttcttatgattaatgcagctaaatttcccactgcagccggtagcatattgcttcataaatgtctataaaaaaatacgaaaaatagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatsatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaag

SEQ ID NO: 79600 - DNA, 601 bp, Human
tcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaarttaatgtcatttttataactatctgcatttcaggtacagtgatctcctttaaaaaggctgcgtcccagcagcatagaccagctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggctttt

SEQ ID NO: 79601 - DNA, 601 bp, Human
gtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcattttyataactatctgcatttcaggtacagtgatctcctttaaaaaggctgcgtcccagcagcatagaccagctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaattt

SEQ ID NO: 79602 - DNA, 601 bp, Human
caggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcatttttataactatctgcatttcaggtacagtgatctcctttaaaaaggctgcgtcccagcagcatagaccarctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagt

SEQ ID NO: 79603 - DNA, 601 bp, Human
caaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcatttttataactatctgcatttcaggtacagtgatctcctttaaaaaggctgcgtcccagcagcatagaccagctttacctcccagcgtagtcttcagacaagttrgggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctcttta

SEQ ID NO: 79604 - DNA, 601 bp, Human
gaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactatgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataa

SEQ ID NO: 79605 - DNA, 601 bp, Human
tttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcagtagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgt

SEQ ID NO: 79606 - DNA, 601 bp, Human
atttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaattagcaaagaagcaaatatgacaaaatgctaacaattccaaaatgctaataacttctgagtggtgagtataagtgtgattattatattattcttagtatttggtttttttctgtagtgtgtagtttccctccatgacactgagggctcagatggctctgaccttggagacagggagacatttagtgaaggaatgggaggtaa

SEQ ID NO: 79607 - DNA, 601 bp, Human
tccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcgagcaatccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggtttttttctgtagtgtgtagtttccctccatgacactgagggctcagatggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccat

SEQ ID NO: 79608 - DNA, 601 bp, Human
agagacggggttttgccatgttggccaagctgatctggaactcatgtgctcgagcaatccacccacctcggcctcccaaaatgctgggataacaggcatgaaccaccatgcccggccatcagaaatattttatttcactattttaaaaaattagcaaagaagcaaatatgacaaaatgctaacaattccaaaatgctaataacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccc

SEQ ID NO: 79609 - DNA, 601 bp, Human
tgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaa

SEQ ID NO: 79610 - DNA, 601 bp, Human
cccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaa

SEQ ID NO: 79611 - DNA, 601 bp, Human
taaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacatgtccaaagtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaat

SEQ ID NO: 79612 - DNA, 601 bp, Human
gatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatg

SEQ ID NO: 79613 - DNA, 601 bp, Human
ccagtggaaatgattcccggtagaatgtcctatgttccttttgcacatttctccttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttaca

SEQ ID NO: 79614 - DNA, 601 bp, Human
cgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgcct

SEQ ID NO: 79615 - DNA, 601 bp, Human
atctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcc

SEQ ID NO: 79616 - DNA, 601 bp, Human
agagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagataattacaacatagggacacccggggaaaatgtagacgaggtttaggggttgctcagaggaggaattaact

SEQ ID NO: 79617 - DNA, 601 bp, Human
gattcctgtgtgctgattattagtgccttgcctacaaatttttaatacattgacttatctaaatattcctgcatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtgatctttcacatcagtttgc

SEQ ID NO: 79618 - DNA, 601 bp, Human
ggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatttcattgcattggaaagacctccaggattctctgcagaagaatctttcccaacataaaatccattgttaatcacatttgacacacatgtgtgcccatgtctctgggcctgtgtccataggcatcta

SEQ ID NO: 79619 - DNA, 601 bp, Human
tgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaartaagtaaataaatgcctctgtgaatccatttcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaa

SEQ ID NO: 79620 - DNA, 601 bp, Human
ggtggctcacgcctgtaattccagcactctgggaggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatytcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttggggtacaactcagt

SEQ ID NO: 79621 - DNA, 601 bp, Human
aggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatttcattgcattggaaagacctccaggattctctscagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttggggtacaactcagtaacccattggtgcagatatgtgattcttaggat

SEQ ID NO: 79622 - DNA, 601 bp, Human
tctgtgaatccatttcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaaga

SEQ ID NO: 79623 - DNA, 601 bp, Human
gtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatacaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatga

SEQ ID NO: 79624 - DNA, 601 bp, Human
ccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagtttgagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttg

SEQ ID NO: 79625 - DNA, 601 bp, Human
tgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagactgaccttttcacttactgtaaggtatctaagacttctgggtgtgggttttaaatatattttggatgagctttgttcatgtttacacatggccaccaggtcggccacaaagctgtggctctggtcagtctgactctctttagcaggaatcacgtgacaatctgtgtctgtgattagctccgtggatattactaggtagatttctcacttgtccttgttt

SEQ ID NO: 79626 - DNA, 601 bp, Human
tctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttctcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcggccacaaagctgtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtg

SEQ ID NO: 79627 - DNA, 601 bp, Human
ccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacayatcctgctccccactcccctaattactcatgattgcactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggat

SEQ ID NO: 79628 - DNA, 601 bp, Human
ccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacacatcctgctccccactcccctaattactcatgattscactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatg

SEQ ID NO: 79629 - DNA, 601 bp, Human
acattcccatgggagctccaactctgtttggtcccaatgtgccctttttgtctcactccttcctcccacacatcctgctccccactcccctaattactcatgattgcactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagcccccaaaatgcattatagctgaaacccccaaagggggatttctaacacagaaagcaacataagtgggtagtcctggccaatggcagctacgttccacaaagtgactcagggatccaggctgcagccacttagtggttccattctccctgctgatatctgcatccagtcatctggtatttcttaccagccttaacctcattctatt

SEQ ID NO: 79630 - DNA, 601 bp, Human
ctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagccacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgagg

SEQ ID NO: 79631 - DNA, 601 bp, Human
gaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatgcattatagctgaaacccccaaagggggatttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctccagtctctggtataaacttgagtcttctctttggtccctgataaatatacatagaa

SEQ ID NO: 79632 - DNA, 601 bp, Human
ctgaaaagtaggatgtcaaatatcctctagccctttgctcaggaagaagagcaaatggatttttgttaagaagctggcagtctgtcacaggagctacttgaggatacacacagttttctccccattagcatctccagtctctggtataaacttgagtcttctctttggtccctgataaatatacatagaatgtatggatgtgagaaagttaaactgatgtctgtgtgtcttcatgtcattaaactttgaatctacggacatgtctttttctttctggcatagtttggaggtcttcattttrtgattgaatacaaaacaccgagggctttaaggaggcatagtggtatgttcagctgtattttctcataatatagagtcataggaaacctgagccttggcatttgtaaggcgaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataa

SEQ ID NO: 79633 - DNA, 601 bp, Human
aagtaggatgtcaaatatcctctagccctttgctcaggaagaagagcaaatggatttttgttaagaagctggcagtctgtcacaggagctacttgaggatacacacagttttctccccattagcatctccagtctctggtataaacttgagtcttctctttggtccctgataaatatacatagaatgtatggatgtgagaaagttaaactgatgtctgtgtgtcttcatgtcattaaactttgaatctacggacatgtctttttctttctggcatagtttggaggtcttcattttgtgatwgaatacaaaacaccgagggctttaaggaggcatagtggtatgttcagctgtattttctcataatatagagtcataggaaacctgagccttggcatttgtaaggcgaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatct

SEQ ID NO: 79634 - DNA, 601 bp, Human
cagttttctccccattagcatctccagtctctggtataaacttgagtcttctctttggtccctgataaatatacatagaatgtatggatgtgagaaagttaaactgatgtctgtgtgtcttcatgtcattaaactttgaatctacggacatgtctttttctttctggcatagtttggaggtcttcattttgtgattgaatacaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactc

SEQ ID NO: 79635 - DNA, 601 bp, Human
aaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcact

SEQ ID NO: 79636 - DNA, 601 bp, Human
ctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactmaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcaca

SEQ ID NO: 79637 - DNA, 601 bp, Human
ccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactaawtgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcacatt

SEQ ID NO: 79638 - DNA, 601 bp, Human
ggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaata

SEQ ID NO: 79639 - DNA, 601 bp, Human
tttgagccatattcagtagtcccagccttacttgttcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgrtgacttcttgctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctg

SEQ ID NO: 79640 - DNA, 601 bp, Human
tattcagtagtcccagccttacttgttcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttctygctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgct

SEQ ID NO: 79641 - DNA, 601 bp, Human
tcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtag

SEQ ID NO: 79642 - DNA, 601 bp, Human
actatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagctcactacagcttcaacctcctgggatcaagcagtcttcttgccttagccacccgagtagctggatgacaggtgagcaccaccatgccyggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcctacctaatgctcttcctggatgggagaatattaccaaaaacgtttggtcgactaattt

SEQ ID NO: 79643 - DNA, 601 bp, Human
ctatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagctcactacagcttcaacctcctgggatcaagcagtcttcttgccttagccacccgagtagctggatgacaggtgagcaccaccatgcctrgctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcctacctaatgctcttcctggatgggagaatattaccaaaaacgtttggtcgactaatttt

SEQ ID NO: 79644 - DNA, 601 bp, Human
gggatcaagcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgsgatgtgcctacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaa

SEQ ID NO: 79645 - DNA, 601 bp, Human
gcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcmtacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtcta

SEQ ID NO: 79646 - DNA, 601 bp, Human
cagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactaatgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttcc

SEQ ID NO: 79647 - DNA, 601 bp, Human
aactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactgttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgt

SEQ ID NO: 79648 - DNA, 601 bp, Human
ccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagatcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctg

SEQ ID NO: 79649 - DNA, 601 bp, Human
gtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgacgctggtgcctaacttctagttccagacaaagaaggagagagagagagrtcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtgga

SEQ ID NO: 79650 - DNA, 601 bp, Human
aataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattt

SEQ ID NO: 79651 - DNA, 601 bp, Human
ggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagca

SEQ ID NO: 79652 - DNA, 601 bp, Human
atcccggggcagtttgtggattctgcagcagacaggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgcccsatgatataccagcgccatgttgtcatcaaaacgaccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatat

SEQ ID NO: 79653 - DNA, 601 bp, Human
aggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgccccatgatataccagcgccatgttgtcatcaaaacraccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcag

SEQ ID NO: 79654 - DNA, 601 bp, Human
gtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcacagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctgccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagcc

SEQ ID NO: 79655 - DNA, 601 bp, Human
tagttttgttatgaggagtaaatgagtcactatttctgagacacttcgtgcctggcacagaacgagcactgtgtgtgtgttacagaaatatatgtgggtgggtgtgtttctgttttccgtaattccagctaggcaaagacatatttaacaaaagccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagagga

SEQ ID NO: 79656 - DNA, 601 bp, Human
aaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttgg

SEQ ID NO: 79657 - DNA, 601 bp, Human
gaaagctaaacgtgcttatctatagtggttattattactagaaagaatatcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacascgcacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcctggctaatttttgtatttttagtagagatggggtttcactatgttggccaggctggtctcgaactcctgggctcaagcaatgcactggccttggcctcccacattgctgggattacaggcgtgagccaccatgcctggccccctttcacttgta

SEQ ID NO: 79658 - DNA, 601 bp, Human
aagctaaacgtgcttatctatagtggttattattactagaaagaatatcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacaccscacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcctggctaatttttgtatttttagtagagatggggtttcactatgttggccaggctggtctcgaactcctgggctcaagcaatgcactggccttggcctcccacattgctgggattacaggcgtgagccaccatgcctggccccctttcacttgtatt

SEQ ID NO: 79659 - DNA, 601 bp, Human
tacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcagcacgcattgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagt

SEQ ID NO: 79660 - DNA, 601 bp, Human
gtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtstgctagaaacctagggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacagg

SEQ ID NO: 79661 - DNA, 601 bp, Human
gggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtctgctagaaacctasggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccact

SEQ ID NO: 79662 - DNA, 601 bp, Human
tcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacgc

SEQ ID NO: 79663 - DNA, 601 bp, Human
ttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacgcag

SEQ ID NO: 79664 - DNA, 601 bp, Human
tgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacrcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggggggggggataaagatattaatttggaagcatttgattgctccattattttatcatcttcccatggaaatgttttcataacgccttgttttttaattattattattattttttgagacagagtctcactgagtcgccc

SEQ ID NO: 79665 - DNA, 601 bp, Human
gtaatttctgttctaatctaaggggtttgaggttatcttttgacaatagatgttagctaggagagataagaaatggagcaagggaggggtttcatcccgccgtgttcatttgcttggctgtcctgaaattgcgaatacgcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaagsggggggggataaagatattaatttggaagcatttgattgctccattattttatcatcttcccatggaaatgttttcataacgccttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccagg

SEQ ID NO: 79666 - DNA, 601 bp, Human
taatttctgttctaatctaaggggtttgaggttatcttttgacaatagatgttagctaggagagataagaaatggagcaagggaggggtttcatcccgccgtgttcatttgcttggctgtcctgaaattgcgaatacgcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggrgggggggataaagatattaatttggaagcatttgattgctccattattttatcatcttcccatggaaatgttttcataacgccttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggc

SEQ ID NO: 79667 - DNA, 601 bp, Human
aggggtttcatcccgccgtgttcatttgcttggctgtcctgaaattgcgaatacgcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggggggggggataaagatattaatttggaagcatttgattgctccattattttatcatcttcccatggaaatgttttcataacgcsttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgccc

SEQ ID NO: 79668 - DNA, 601 bp, Human
tcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcrtaggtctctgaaaattcagacccacagaggccttaccccgctacagagaggccccaagagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagtt

SEQ ID NO: 79669 - DNA, 601 bp, Human
gcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcgtargtctctgaaaattcagacccacagaggccttaccccgctacagagaggccccaagagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagtttta

SEQ ID NO: 79670 - DNA, 601 bp, Human
gtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcgtaggtctctgaaaattcagacccacagaggccttaccccgctacagagaggccccargagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcac

SEQ ID NO: 79671 - DNA, 601 bp, Human
tgagccaccgcgcccagcccatgacttctcttcatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatcactgatgaccatttgagacataatttggagaaggtttctatcaaatcctagytggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttaagggagcaagagatcaggtcttctg

SEQ ID NO: 79672 - DNA, 601 bp, Human
tctatttaaaaaaatcatagcgtctaggggatatacacttctaagcccattcttcaatggagaattacttatgcgcataagtagtttaaacaaaattagtggaaaaacagggagtttaagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgctcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtatacc

SEQ ID NO: 79673 - DNA, 601 bp, Human
aggaatctggggcattcgcgttagagacaattttcttctcctcaagataagggatggggaattagtcatagggtatttccagataatgtagttaacacctcgtgtaatattaggtgggcagggagctctgctctcaggaccaaaattgctcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattggtcaaggaaaggtttagcatggagagatttctcttaaggtgcctaggtattcagaagcacccctaaaa

SEQ ID NO: 79674 - DNA, 601 bp, Human
gcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacgcatcccttttcacatttgaatcgcaactctgtcattcaccagctgtgcatccttgggaaagtcacttag

SEQ ID NO: 79675 - DNA, 601 bp, Human
ctcgttagtgcaagaaataatttaacaactgaaaaagatgtgaggttgtacctggtaaggtctctattggtcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacscatcccttttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcgttttactccttgtctcacattcctttctgctacttctctttggctcaccaaaaggagacagaagtttgtgtccatggctgtgaactgccaaagagttgccaattctctacgatctttgacctctgtg

SEQ ID NO: 79676 - DNA, 601 bp, Human
gtgcaagaaataatttaacaactgaaaaagatgtgaggttgtacctggtaaggtctctattggtcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacgcatcccktttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcgttttactccttgtctcacattcctttctgctacttctctttggctcaccaaaaggagacagaagtttgtgtccatggctgtgaactgccaaagagttgccaattctctacgatctttgacctctgtgatcccag

SEQ ID NO: 79677 - DNA, 601 bp, Human
gagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagagragaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctc

SEQ ID NO: 79678 - DNA, 601 bp, Human
agagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagaggwgaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcc

SEQ ID NO: 79679 - DNA, 601 bp, Human
ttacagaggagaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaa

SEQ ID NO: 79680 - DNA, 601 bp, Human
ttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatag

SEQ ID NO: 79681 - DNA, 601 bp, Human
aacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatt

SEQ ID NO: 79682 - DNA, 601 bp, Human
agcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcag

SEQ ID NO: 79683 - DNA, 601 bp, Human
tgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtac

SEQ ID NO: 79684 - DNA, 601 bp, Human
cttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacawtaatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagat

SEQ ID NO: 79685 - DNA, 601 bp, Human
tgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtcctt

SEQ ID NO: 79686 - DNA, 601 bp, Human
tgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcg

SEQ ID NO: 79687 - DNA, 601 bp, Human
cctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaat

SEQ ID NO: 79688 - DNA, 601 bp, Human
gccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctg

SEQ ID NO: 79689 - DNA, 601 bp, Human
agttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaac

SEQ ID NO: 79690 - DNA, 601 bp, Human
gttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactgscaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaccacatgaaggttatattatta

SEQ ID NO: 79691 - DNA, 601 bp, Human
tcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgataytgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaccacatgaaggttatattattatgtcgactttccagatgagga

SEQ ID NO: 79692 - DNA, 601 bp, Human
ctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggcttgtcataggtgtcaaagacaggagtccagtgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttc

SEQ ID NO: 79693 - DNA, 601 bp, Human
ccatccctatttatgaaaacaaaaagataactaaattgaaaccttgacaatgtaatttgtcagaggaaggcagcctgttttataagctcaggtgatttcatttttgttcacctgtttatttcatgacacttgcaggaaaaagaggaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatata

SEQ ID NO: 79694 - DNA, 601 bp, Human
tgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctattcagctttaaagagtttgagagcgttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagc

SEQ ID NO: 79695 - DNA, 601 bp, Human
cacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttgctgggagaaggtcagagctggagtggggcactcgattccggcaagagaaggcaaacaaaagaagccacaacagtctaggaagaaatctttaatttctattcagctttaaagagtttgagagmgttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttgaaaaagacatacctttgtaactttctatgctaaggtg

SEQ ID NO: 79696 - DNA, 601 bp, Human
attatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggt

SEQ ID NO: 79697 - DNA, 601 bp, Human
atggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaamagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaa

SEQ ID NO: 79698 - DNA, 601 bp, Human
agctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttygtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgta

SEQ ID NO: 79699 - DNA, 601 bp, Human
ctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcrtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcat

SEQ ID NO: 79700 - DNA, 601 bp, Human
tgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctgcttggccacttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccgg

SEQ ID NO: 79701 - DNA, 601 bp, Human
gtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagctggaaaatttcagtgacatgccatcagatttgttccatgtagaaggacgacactatcagttagatgcttattttgttggcaaatttctatggcacttctgcttggcyacttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgtta

SEQ ID NO: 79702 - DNA, 601 bp, Human
ttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagctggaaaatttcagtgacatgccatcagatttgttccatgtagaaggacgacactatcagttagatgcttattttgttggcaaatttctatggcacttctgcttggccayttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttagg

SEQ ID NO: 79703 - DNA, 601 bp, Human
tattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccaaggtcaccctgcccttcaatcctgctgatagcccaagttaacatcctcccatgccttggccttcccagaacaaacatggctttggacgcctttgggt

SEQ ID NO: 79704 - DNA, 601 bp, Human
atgtaatgacccacatggattgccttgaagccgtttctttttccttccctcgttaggagtaccctcaccctaaccccagcaaagcatgtctagggtctcacaataacagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgasagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgc

SEQ ID NO: 79705 - DNA, 601 bp, Human
taatgacccacatggattgccttgaagccgtttctttttccttccctcgttaggagtaccctcaccctaaccccagcaaagcatgtctagggtctcacaataacagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagygtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctct

SEQ ID NO: 79706 - DNA, 601 bp, Human
cccacatggattgccttgaagccgtttctttttccttccctcgttaggagtaccctcaccctaaccccagcaaagcatgtctagggtctcacaataacagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccmaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaag

SEQ ID NO: 79707 - DNA, 601 bp, Human
attctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccaaggtcaccctgcccttcaatcctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgcaaacaggaaaggccacagg

SEQ ID NO: 79708 - DNA, 601 bp, Human
aaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgcaaacaggaaaggccacaggacagytcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtccccagtgtcacctggggaatgacactcttcacctgtcatgggagaggcaactgaaaaggagcctgaggtttttctacctttgtgaacctgt

SEQ ID NO: 79709 - DNA, 601 bp, Human
tgtatgacacttccttctagccagactcggatttgggggcatcatatttgggatggctgcaccgcaaacaggaaaggccacaggacagctcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcatgttctcttctggagggctaagagttggcatgggatctaaatggattctccagaacactttctcacacttctaaagcctgaaaacaaatatttgctttcctgatcatcttcattgtttctttttgggaaa

SEQ ID NO: 79710 - DNA, 601 bp, Human
tttctctcaaggtgtcccttgtaatttgtggttgtggtctgtgcttgaacctgttgcatttatggtgatggactggcactttactctctctgagccacggccatcaagcccctgtcatagacactgtccccagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtag

SEQ ID NO: 79711 - DNA, 601 bp, Human
aggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagarctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttggttggttagcacttattccaaattgaattgtataatttcattatagaagtatcacggtggaagaagagggtgacttactg

SEQ ID NO: 79712 - DNA, 601 bp, Human
aggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagagctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttggttggttagcacttattccaaattgaattgtataatttcattatagaagtatcacggtggaagaagagggtgacttactggtgtggtcacctagccagggaggcctatgagcctcattcctgtatagg

SEQ ID NO: 79713 - DNA, 601 bp, Human
gacgagttgcttttgatctctgatatcaggtaggcttctctctaaataaatggaaatactaactgtccctggctcatagagctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcac

SEQ ID NO: 79714 - DNA, 601 bp, Human
gggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcctagtggtgtattcacagagtcagtggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtc

SEQ ID NO: 79715 - DNA, 601 bp, Human
acatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaa

SEQ ID NO: 79716 - DNA, 601 bp, Human
tcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagat

SEQ ID NO: 79717 - DNA, 601 bp, Human
gcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattakacttgagccacacaaatcaatgggaaaagaaacagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagat

SEQ ID NO: 79718 - DNA, 601 bp, Human
agttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagytgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaat

SEQ ID NO: 79719 - DNA, 601 bp, Human
aaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagctgaatccagsataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaaca

SEQ ID NO: 79720 - DNA, 601 bp, Human
acagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacarcaatgacaacaacaaacccaagtctgccttatggcacattcttcacgtcgtaacaccttccttgggaccctatttctcagtatggacctgactctcccagggatcctagaatgcaagcatagtgattgcaaaccagaccatttgagggaaactcctctagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttacc

SEQ ID NO: 79721 - DNA, 601 bp, Human
atggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaacaaacccaagtctgccttatggcacattcttcacrtcgtaacaccttccttgggaccctatttctcagtatggacctgactctcccagggatcctagaatgcaagcatagtgattgcaaaccagaccatttgagggaaactcctctagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaa

SEQ ID NO: 79722 - DNA, 601 bp, Human; identical to SEQ ID NO: 38328

SEQ ID NO: 79723 - DNA, 601 bp, Human
acccctgacacacaccccattttgagaactgagtggggctgggaagagccagtggcaaagggaggggaagagggaagggcagaaagtaggtggggcccccctttggtggcctcttctctccacggccccaggctccagcccacttgggtccttggcgttggtggcagcagcacttgggccatggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtact

SEQ ID NO: 79724 - DNA, 601 bp, Human
ggtggcctcttctctccacggccccaggctccagcccacttgggtccttggcgttggtggcagcagcacttgggccatggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccrggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctgacagcagctgccagctgctgctctcctctagccc

SEQ ID NO: 79725 - DNA, 601 bp, Human; identical to SEQ ID NO: 24547

SEQ ID NO: 79726 - DNA, 601 bp, Human; identical to SEQ ID NO: 34289

SEQ ID NO: 79727 - DNA, 601 bp, Human; identical to SEQ ID NO: 34290

SEQ ID NO: 79728 - DNA, 601 bp, Human; identical to SEQ ID NO: 34291

SEQ ID NO: 79729 - DNA, 601 bp, Human; identical to SEQ ID NO: 34292

SEQ ID NO: 79730 - DNA, 601 bp, Human; identical to SEQ ID NO: 34293

SEQ ID NO: 79731 - DNA, 601 bp, Human; identical to SEQ ID NO: 34294

SEQ ID NO: 79732 - DNA, 601 bp, Human; identical to SEQ ID NO: 34295

SEQ ID NO: 79733 - DNA, 601 bp, Human
cctcctttttcaggtcttggctcaagggtcaagccctttgggaaggcctctggtcgggaagccgccattacatctctaggcccctggcttggctccttgaagtcttcacctcatgtcaagataattattaactaattatttggataattgtttgaataacatctgcatctgtccccgctagactccaggtgctgagagcagggactgtgtctctgcttgtacagcacccagcacagtggccggtgtttaatagctgtttgttgaatgaataaatgattcatgaacggggtttccagagaamctgcctacaacggcagggaaagatgggaaagatccataaggatcttaaggactaccaatttggggtgaggtcacataggtttggggtcaacccaaggattaaaataacaatctagaaggttctggaaggggctgagtatgaagacagaatactagaggccgggctcggtggctcatgcctgtaatcctggcactttgggaggctgacgcgggctacttgaagttagaagttcgagaccagcctaaccaacatggcgaaaccccgtctctgctgaaaatacaaaaattagttgggcgtggt

SEQ ID NO: 79734 - DNA, 601 bp, Human
aaaagctaactttaagcaaatgattaggtcaaaagttataaaaatggttttcagagcctcaagtccaggatatggacagggaaaacaaccttgattaggattctgactcaggcatcgccggtgtcattggagcaggagccttctgtctttgagtcctaggtttctctgccatgaaattggagtaattacaatgcacctacctcgccaggttgttgaggactccacaaggcgtagcgtgtgggtctcctagcctagggtgtggcactcaggagtggcacgggcatgaatccagggagtgtcrccagaggagaaaagccaccccaccttcaggccaaggatggtgccaggtgccaggcacccacagatccctcctttttcaggtcttggctcaagggtcaagccctttgggaaggcctctggtcgggaagccgccattacatctctaggcccctggcttggctccttgaagtcttcacctcatgtcaagataattattaactaattatttggataattgtttgaataacatctgcatctgtccccgctagactccaggtgctgagagcagggactgtgtctctgcttgtacagcacccagcac

SEQ ID NO: 79735 - DNA, 601 bp, Human
caacaggcaccttaactgctttattcagtaccatattcccaggacctaacacagcgcctggcacacaatgggggctcaataaataaatgctgtgtgtgccaggcactgtgtctggcattgaaagcacagcaggggtccgtgggacagggagaatccaatcctgaacatgcatgccattttgtgactgtgtgaccttatgcaaatcaccagcctcagtttccccagctgtcaagtagaaaaagtaatagttcatctctcattgcgcagttgaagaattcaagatgatcctgcatttcaaacsgtgcagcacagcaggtggcatggagagcactcagtcagtgggaaatgttattattaattattagctacaacaggaggtccctctgcctccctagctagtttccccaactacagggcaagcagttggattagctcagtggtttgcagttagggacagaagttgtcggtgagcacaggatcattttagatggtagagagatgagatttaagtaacgttaaatcgcacactcagacgctgaaccagcatccagttctcttttaaacctgattttgtcaaggataaagtctcaggatggtgcta

SEQ ID NO: 79736 - DNA, 601 bp, Human
ttcacatttgtatgtattcgtttttaaaaatctctccactttgactgtaagctccattgacaacaggcaccttaactgctttattcagtaccatattcccaggacctaacacagcgcctggcacacaatgggggctcaataaataaatgctgtgtgtgccaggcactgtgtctggcattgaaagcacagcaggggtccgtgggacagggagaatccaatcctgaacatgcatgccattttgtgactgtgtgaccttatgcaaatcaccagcctcagtttccccagctgtcaagtagaaaargtaatagttcatctctcattgcgcagttgaagaattcaagatgatcctgcatttcaaaccgtgcagcacagcaggtggcatggagagcactcagtcagtgggaaatgttattattaattattagctacaacaggaggtccctctgcctccctagctagtttccccaactacagggcaagcagttggattagctcagtggtttgcagttagggacagaagttgtcggtgagcacaggatcattttagatggtagagagatgagatttaagtaacgttaaatcgcacactcagacgctgaac

SEQ ID NO: 79737 - DNA, 601 bp, Human
ccatgctcccccggcccccacatactcctttagacagtgtgcggcagtgaggacccatttggggtggaccaggactcccccacagagtagccgcccttgcactagtagggcagcctgccagggctgagagtgggggaagcaggtgtagccacctgggagaaacccactggtcccattggtgttgagaaccttggaagactcctgggagacacctggtaaagaagagagattgttagaaaactgggatccagggggcagaggagccctggggttgtggtttctgggtttggggtaagggtcrgattattgccctgggtgaccaggaactgaagatgaatttgccgacctatggcagttgctattcttgaccaagtggagatgaattagggcaaaggggtgacattattttctcaggaagtaccaaatcctccactgggggttaacagaagagttcacaaaatgaggatgttgctgataggtaagcaggagcctgactttctctccacatgcattttttatatcattctaccagaagatggatttcaggaggtagaagtgagactgacctacacatccacctaggcaatatctatccatcaat

SEQ ID NO: 79738 - DNA, 601 bp, Human
tttgtccctgcccctctccagcacccacagttaactatgtgactcaggcttggcccatcagagaatcccacagctctggtggagtgatggctcaagacacatgacttaggtcagcctagtgagaatcatgcttaagacttttgtgtgaactattggaaaagagaggttctctttctaatagggttgcctagagggtaggatgtaagctcaaagctgctggggccatcttgtcatgggaagaatctaaccgagaatgaagccaaaacagaataaagaagagctgagagttaaaagaaagacwgaattccaaacacacaatttgcatacctggatccatctgtgcctaaagccagacaacctggattttcagttacaaaagcctgcattttgtttaagccagtttgagttggttgtctatcactcacaagtgaaagaataccaacctttatgcatctcaacacagggatcttggcagccactcagtcaaagctggggcttatgatgaattattcctgccatccctgggtacccctttttgtcttgacctcctatgtgaggggacattgtatcttataaagattggttcccctaaggctggaaa

SEQ ID NO: 79739 - DNA, 601 bp, Human
acctcagcctcccaaagtgctgggattacaggcatgaactactgtacttggccatttccccttattttggtaacagcctctcctgattttttcatttggggaactgcccttctccacttccaatccatgcagtttgtccctgcccctctccagcacccacagttaactatgtgactcaggcttggcccatcagagaatcccacagctctggtggagtgatggctcaagacacatgacttaggtcagcctagtgagaatcatgcttaagacttttgtgtgaactattggaaaagagaggttstctttctaatagggttgcctagagggtaggatgtaagctcaaagctgctggggccatcttgtcatgggaagaatctaaccgagaatgaagccaaaacagaataaagaagagctgagagttaaaagaaagacagaattccaaacacacaatttgcatacctggatccatctgtgcctaaagccagacaacctggattttcagttacaaaagcctgcattttgtttaagccagtttgagttggttgtctatcactcacaagtgaaagaataccaacctttatgcatctcaacacagggatct

SEQ ID NO: 79740 - DNA, 601 bp, Human
atttatttctttttgttttagagacagggccttgctctatcacccaggctggagtgcagtggcatgatcatacctcactgcagccttgaactcctgggttcaaatagtccttctgcctcagcctcccgagtaactaggactgcagttgtactccaccacacctggctaatttaaaaacttttttttctttttgtagagacagagtctcactatgttgcccaggctggtctcaaactcctgggctcaagtaatcctctcacctcagcctcccaaagtgctgggattacaggcatgaactacygtacttggccatttccccttattttggtaacagcctctcctgattttttcatttggggaactgcccttctccacttccaatccatgcagtttgtccctgcccctctccagcacccacagttaactatgtgactcaggcttggcccatcagagaatcccacagctctggtggagtgatggctcaagacacatgacttaggtcagcctagtgagaatcatgcttaagacttttgtgtgaactattggaaaagagaggttctctttctaatagggttgcctagagggtaggatgtaagctcaa

SEQ ID NO: 79741 - DNA, 601 bp, Human
tcactgaatccaatctcaacttctttattgatgaaggctattttttgctcatgtagtatccatttcctcttatttttaaaaaattaaacattcatttttaaatttttatttatttatttattagagacagtgtcttgctctatttatttctttttgttttagagacagggccttgctctatcacccaggctggagtgcagtggcatgatcatacctcactgcagccttgaactcctgggttcaaatagtccttctgcctcagcctcccgagtaactaggactgcagttgtactccaccacrcctggctaatttaaaaacttttttttctttttgtagagacagagtctcactatgttgcccaggctggtctcaaactcctgggctcaagtaatcctctcacctcagcctcccaaagtgctgggattacaggcatgaactactgtacttggccatttccccttattttggtaacagcctctcctgattttttcatttggggaactgcccttctccacttccaatccatgcagtttgtccctgcccctctccagcacccacagttaactatgtgactcaggcttggcccatcagagaatccca

SEQ ID NO: 79742 - DNA, 601 bp, Human
acagtgtgagagaaagcaatgaagacagtgagaaacagacaagaagacaaacacagagggacagacagcaagagacagaaatagggacagaaagacagagataggcccagagaaagagagacacagagaaatttctgtgtttttctctgttcctcagtttcattaaaatggtaacaacttacttcatacccatttttgtttccctggtacgaaatcccaccttgcaccccctgccccacaccagctgaccctgctcctatttaaggctcatttgtgtctctcactattgagtgaacccatycatatctgggcagggtatgcaacacacgtgtaagtctatttctcttcctgggcccaaggcagacatcactaatcgatcaaggcacatatcattaatatagtatcatactctttctcactgaatccaatctcaacttctttattgatgaaggctattttttgctcatgtagtatccatttcctcttatttttaaaaaattaaacattcatttttaaatttttatttatttatttattagagacagtgtcttgctctatttatttctttttgttttagagacagggccttgctctatcaccc

SEQ ID NO: 79743 - DNA, 601 bp, Human
aggcagggacagggaggtgtggggagagagtgaaagatggagagagacacacacagagaaggagactcagagaggcagagtcagacacacacagtgtgagagaaagcaatgaagacagtgagaaacagacaagaagacaaacacagagggacagacagcaagagacagaaatagggacagaaagacagagataggcccagagaaagagagacacagagaaatttctgtgtttttctctgttcctcagtttcattaaaatggtaacaacttacttcatacccatttttgtttccctggtackaaatcccaccttgcaccccctgccccacaccagctgaccctgctcctatttaaggctcatttgtgtctctcactattgagtgaacccattcatatctgggcagggtatgcaacacacgtgtaagtctatttctcttcctgggcccaaggcagacatcactaatcgatcaaggcacatatcattaatatagtatcatactctttctcactgaatccaatctcaacttctttattgatgaaggctattttttgctcatgtagtatccatttcctcttatttttaaaaaattaaacattcatt

SEQ ID NO: 79744 - DNA, 601 bp, Human
tgtttcacggatccacaggacgtatcttgagacacgggtgtagacaccaggccggtcaggttgcccacatgggaagtctccccaggagacgatgccatacagtgttctgttacagaccagggggcccccagagtcaccctgagttggggaaagaaagagagagagaggtgggtccttgctggggctaaacaaggcagggacagggaggtgtggggagagagtgaaagatggagagagacacacacagagaaggagactcagagaggcagagtcagacacacacagtgtgagagaaagcaaygaagacagtgagaaacagacaagaagacaaacacagagggacagacagcaagagacagaaatagggacagaaagacagagataggcccagagaaagagagacacagagaaatttctgtgtttttctctgttcctcagtttcattaaaatggtaacaacttacttcatacccatttttgtttccctggtacgaaatcccaccttgcaccccctgccccacaccagctgaccctgctcctatttaaggctcatttgtgtctctcactattgagtgaacccattcatatctgggcagggtatg

SEQ ID NO: 79745 - DNA, 601 bp, Human
taagcagatccttcattcattcactcattcattcgctctgtgaatgagggaacagacatgaaatgtggacaaggaaccattcttaagaaacccagtccaaagaggcaggccaaggggaaaagacgtccattagagtgacaatgtccacatcttcaccccagctctgcatctggctagaactttgataagagtgagccccagtttcccctccccgccactgcatgtgtgggttccagggcttcaaaactctaaatggcttttagttcaaatgtgatactctgcaatctcccagcccttcccctaactccaggctcattcaaacaggccacccaggcacccagggcagagtctgtccgtctgcagaccagctgaccgcctaatctgtctccctggttgaaagggcaatggtatgcaaagttaggatcagaggaaagacctaaggctgcgtgcactcagaggaccttgggctgctgcctgcctctgcatgaatctggggagaaaagcggcttatagtttccagactgaatcatggaggcagtgagcagggagaacagagtcgcgcattctgcctctgggagagggttcctatggggagattctg

SEQ ID NO: 79746 - DNA, 601 bp, Human
tatccacagaaggatgctgggaggctcctgttcaactttaagccagatgctcctagctccaggacaattgaggacaatgtggttttcctctttagaagcccaggagaggagtggggaaatttggtggtgcatgcatgtgtggtgcacacacacacacacacaccctactgacatacttaacctgatgacatcctgagaaagaaaacaccttgaaataagcccccgaataactgagttggcaagactctttacctggcataagtccccacactcccatagcaagagaccaggtgctcactcacagcacagggtcacatgcttgaactgcctgagtgatagcccctctagggaccctgcatacacacagtggggtcctggcactgcagcagccacaaggctgtcactgacacacacgtttcagtatgagtaggccacagaaaaataaagctccctcagtgtaacagagaaagcctctgagctgtcatgggggagaagaggccattctgctgattttcctgccatccccagagacagtgtcaccatccaccgggacctctttgcagtcagattacaggctttggcgggacaagatttgaaaaat

SEQ ID NO: 79747 - DNA, 601 bp, Human
cctgaacacaggctctcttcttccatgctaaggcacttggccgctgctccagcctgggcggttccagaagtggccgtcttgggctgggcgtgtcttcctgccttcacaccactcggccccaaaccaatcgcctttgggatatccacagaaggatgctgggaggctcctgttcaactttaagccagatgctcctagctccaggacaattgaggacaatgtggttttcctctttagaagcccaggagaggagtggggaaatttggtggtgcatgcatgtgtggtgcacacacacacacacaccccctactgacatacttaacctgatgacatcctgagaaagaaaacaccttgaaataagcccccgaataactgagttggcaagactctttacctggcataagtccccacactcccatagcaagagaccaggtgctcactcacagcacagggtcacatgcttgaactgcctgagtgatagcccctctagggaccctgcatacacacagtggggtcctggcactgcagcagccacaaggctgtcactgacacacacgtttcagtatgagtaggccacagaaaaataaagctccctcagtgtaac

SEQ ID NO: 79748 - DNA, 601 bp, Human
tgctcaagtccccgacataaaatgctgtggtatttgcatatcacctatgcacatcctcccgtattctttaaatcatctctaggttacttataatacctaatacgatgtaaatgctatgtcaatagttgttatacagtattgtttttatgtctttttttagttgtattgttattttggggggattttttctgaaaacttttcatctgcagttgattgaatccacggatgcagaacctgcagacacagagggccaactgtagggacttctgttgttaaccaaaaagcatattaaaaaaaaaaataaaagcacaaggcctcccattcaagttgcacacagactcatgtagccaaagaaaacaccagcgggcagtccctgcttatgcgtgtgtctcacccgcctggtcccctgaacacaggctctcttcttccatgctaaggcacttggccgctgctccagcctgggcggttccagaagtggccgtcttgggctgggcgtgtcttcctgccttcacaccactcggccccaaaccaatcgcctttgggatatccacagaaggatgctgggaggctcctgttcaactttaagccagatgctcctagc

SEQ ID NO: 79749 - DNA, 601 bp, Human
ccaagatctgcagatgctcaagtccccgacataaaatgctgtggtatttgcatatcacctatgcacatcctcccgtattctttaaatcatctctaggttacttataatacctaatacgatgtaaatgctatgtcaatagttgttatacagtattgtttttatgtctttttttagttgtattgttattttggggggattttttctgaaaacttttcatctgcagttgattgaatccacggatgcagaacctgcagacacagagggccaactgtagggacttctgttgttaaccaaaaagcayattaaaaaaaaaaataaaagcacaaggcctcccattcaagttgcacacagactcatgtagccaaagaaaacaccagcgggcagtccctgcttatgcgtgtgtctcacccgcctggtcccctgaacacaggctctcttcttccatgctaaggcacttggccgctgctccagcctgggcggttccagaagtggccgtcttgggctgggcgtgtcttcctgccttcacaccactcggccccaaaccaatcgcctttgggatatccacagaaggatgctgggaggctcctgttcaactttaagc

SEQ ID NO: 79750 - DNA, 601 bp, Human
caagttatgtaaaatatatattaatatgtatacatacaggctcctggtacacagaaaagggtctagaaagatccacatcaatgatggtgataatagctcaggaggggaataaaatgggggaaactttctctcttttcctccatttgaacttttttttacgagcaagtattcatatattttatataaagtcgtccctcaatgtcagaggggaattggtttcaggacccccatagataccaagatctgcagatgctcaagtccccgacataaaatgctgtggtatttgcatatcacctatgcrcatcctcccgtattctttaaatcatctctaggttacttataatacctaatacgatgtaaatgctatgtcaatagttgttatacagtattgtttttatgtctttttttagttgtattgttattttggggggattttttctgaaaacttttcatctgcagttgattgaatccacggatgcagaacctgcagacacagagggccaactgtagggacttctgttgttaaccaaaaagcatattaaaaaaaaaaataaaagcacaaggcctcccattcaagttgcacacagactcatgtagccaa

SEQ ID NO: 79751 - DNA, 601 bp, Human
tcaaaggaataccagcagtgatgaaggaaaacgcggggtagacttattgctgagacatggaaaatttttcagctggtatctttgaattgaaaaacaaattgcaagataattatacatgttcaagttcacctacacttagttcaagttatgtaaaatatatattaatatgtatacatacaggctcctggtacacagaaaagggtctagaaagatccacatcaatgatggtgataatagctcaggaggggaataaaatgggggaaactttctctcttttcctccatttgaacttttttttacragcaagtattcatatattttatataaagtcgtccctcaatgtcagaggggaattggtttcaggacccccatagataccaagatctgcagatgctcaagtccccgacataaaatgctgtggtatttgcatatcacctatgcacatcctcccgtattctttaaatcatctctaggttacttataatacctaatacgatgtaaatgctatgtcaatagttgttatacagtattgtttttatgtctttttttagttgtattgttattttggggggattttttctgaaaacttttcatctgcagt

SEQ ID NO: 79752 - DNA, 601 bp, Human
tgcagaagggcaatttggccgtaatcatcaaaactcaaactgagcacacctgctcccaaggccccacttctagaaatccaccctatggaaatgttcatgaaccacacgaagagggatgtgtcgggatatcgctgtcatttgtgacagagaaaatgatcagtcaatggagaaacaggtaaacaagtctataaccattcaaaggaataccagcagtgatgaaggaaaacgcggggtagacttattgctgagacatggaaaatttttcagctggtatctttgaattgaaaaacaaattgcaagrtaattatacatgttcaagttcacctacacttagttcaagttatgtaaaatatatattaatatgtatacatacaggctcctggtacacagaaaagggtctagaaagatccacatcaatgatggtgataatagctcaggaggggaataaaatgggggaaactttctctcttttcctccatttgaacttttttttacgagcaagtattcatatattttatataaagtcgtccctcaatgtcagaggggaattggtttcaggacccccatagataccaagatctgcagatgctcaagtccccga

SEQ ID NO: 79753 - DNA, 596 bp, Human
caagaccatcccggctaactcggtgaaaccccatctgtactaaaaatacaaaaaaaaaattagctgggtgtggtggcaggcacctgcagtcccagctcctcaggaggctgaggcaggagaatggtgtgaacccaggaggcagaggctgcagtgagccgagatcgtgccactgcactccagcctgggcgacagagcgagactccatctcaaaaaagaaaaaaaaaatagcattacagataaagtattaggtttcctttggccacacccccagtgtcctgccttctctcattagagtrgccacttctgttagtctcaccttttcccaaactttaacatattctaatattaagccattgaaaataatggcagggcgcggtggttcacacctatcatcccagtgttttggaaggccaaggcagaaggatcacttaaggccaggagttcgagaccagcctgggtaacatagtgagaccttgtctctacgaaaataaaaataaaaatggaaagaaaatatagaatattgtttggtgggttttttttaaacataaatagcaccagagcttttttcaattagtaatgtgtttttatggcctacc

SEQ ID NO: 79754 - DNA, 601 bp, Human
aaaatgaataatgcacataaacacttggaacagtatccggccacaacgagtgcccattgactgttatctcccatcaacccccatcttttaactgattgacaaagatttcccaaaaggcacaaactcagggacagccggtgacatccctggctggccctggtgccggggctccccaaggctcactgtgtggctctggctgagggaggcaggggtgagctaaagagcctgaggccagggctgggggtcgcgcccgcctcattcattctgtaacctgactggtgttgaaggggtggcaaggagytcaggcgctgctatggccctcggggacgctgcagtgacagtgatgggaaagcccctgcctcagcagatacaggggtatcaggaaaaaagcatgcaggcaaagatgaccgaaggtttttgcctctaccccaggggaaacaaaaggaggtgccgtttattgagacagggatcataggtgggggaagcccagcagcaggacaaggcaaccgaggttgagtccatctagaaaaccaacttaaagacagcagaggggacccaggttctctcctggacatggaagaaggccatgaggcctatcatt

SEQ ID NO: 79755 - DNA, 601 bp, Human
atccatttccctcaataaaataagacacaatagtacctattttagatactaaaatgaataatgcacataaacacttggaacagtatccggccacaacgagtgcccattgactgttatctcccatcaacccccatcttttaactgattgacaaagatttcccaaaaggcacaaactcagggacagccggtgacatccctggctggccctggtgccggggctccccaaggctcactgtgtggctctggctgagggaggcaggggtgagctaaagagcctgaggccagggctgggggtcgcgcycgcctcattcattctgtaacctgactggtgttgaaggggtggcaaggagctcaggcgctgctatggccctcggggacgctgcagtgacagtgatgggaaagcccctgcctcagcagatacaggggtatcaggaaaaaagcatgcaggcaaagatgaccgaaggtttttgcctctaccccaggggaaacaaaaggaggtgccgtttattgagacagggatcataggtgggggaagcccagcagcaggacaaggcaaccgaggttgagtccatctagaaaaccaacttaaagacagcagagg

SEQ ID NO: 79756 - DNA, 601 bp, Human
ggaaggggcagcccaggaagagaatataagaagggcaccccccgccgcccgccttaagcatgcagtcgacctgctcagacacacggagaaccgggaggacgcagtgcgcagaggccaccgggaccagctgtggagtcggcccccagacttgaaatcctgattcaaccgcttggagctatgtgacatggggcaagttactttccgcctctgtgcatccatttccctcaataaaataagacacaatagtacctattttagatactaaaatgaataatgcacataaacacttggaacagtatcyggccacaacgagtgcccattgactgttatctcccatcaacccccatcttttaactgattgacaaagatttcccaaaaggcacaaactcagggacagccggtgacatccctggctggccctggtgccggggctccccaaggctcactgtgtggctctggctgagggaggcaggggtgagctaaagagcctgaggccagggctgggggtcgcgcccgcctcattcattctgtaacctgactggtgttgaaggggtggcaaggagctcaggcgctgctatggccctcggggacgctgcagtga

SEQ ID NO: 79757 - DNA, 601 bp, Human
gatgaagctagaaaactttctgacgggttctctgagggaagtggagagaacagagtcaaggctgagtgcaagatgttggcccgggcaactggaagatgggggggctatgatggagtgggaagctggtgggagccacaggtgtggccgagggtgatgaggagccagccggggcgagcgtgagctgcctttgaccccgagttgagatacggactctgctgttggacactcgggggtggggttcaggggaaaggtctgggcccagggataccaatttgggagtggtcaggacagagatgccatwcaggcgcaaggctggaggagcccaccccagggatgagggatgaggacacacagaaaggatgcctggagctccaccagcaggaggcaggaggccagggagatgaggaggcatcagcaggcaagaagacagagcagccaggaaggtgggaggaaaacccagagaatggagatttaaagcgcctcaagggtccttctagaagcttccagagaaggtgtaaggaacttcacccaaaatgccaggaagtgaacaaggtcaggcccctcccgttccttccccctccccagcacaggcaatcagtga

SEQ ID NO: 79758 - DNA, 601 bp, Human
cctgggccaggttaggacctggctgtgactcctaggggacgggtctggccatgtcagggctttgaggggaggaggtgctaagtgcaatcttgatgggctcccatggctgcttattgagaaaccccactggggagcaaggatgagcacagggaggccagtgaggaggcggatgcaggaatctgggggagaggtgatggtgccttggaccagaggtgatggcgcctcgggcgtggtgagaagtagttggaatctgggtatatttagatgatgaagctagaaaactttctgacgggttctctgmgggaagtggagagaacagagtcaaggctgagtgcaagatgttggcccgggcaactggaagatgggggggctatgatggagtgggaagctggtgggagccacaggtgtggccgagggtgatgaggagccagccggggcgagcgtgagctgcctttgaccccgagttgagatacggactctgctgttggacactcgggggtggggttcaggggaaaggtctgggcccagggataccaatttgggagtggtcaggacagagatgccattcaggcgcaaggctggaggagcccaccccagggat

SEQ ID NO: 79759 - DNA, 601 bp, Human
ggcttgtgtcaggagagctaaggcgattgggcccatggggctgaggaatggccaggaggccattgtgcaagggaaaagggaatgcggacgtcgccagaaaagtggcaggggtggatggcacaggccctgggccaggttaggacctggctgtgactcctaggggacgggtctggccatgtcagggctttgaggggaggaggtgctaagtgcaatcttgatgggctcccatggctgcttattgagaaaccccactggggagcaaggatgagcacagggaggccagtgaggaggcggatgcagsaatctgggggagaggtgatggtgccttggaccagaggtgatggcgcctcgggcgtggtgagaagtagttggaatctgggtatatttagatgatgaagctagaaaactttctgacgggttctctgagggaagtggagagaacagagtcaaggctgagtgcaagatgttggcccgggcaactggaagatgggggggctatgatggagtgggaagctggtgggagccacaggtgtggccgagggtgatgaggagccagccggggcgagcgtgagctgcctttgaccccgagttgagatacgga

SEQ ID NO: 79760 - DNA, 601 bp, Human
tcaaaaggttacatttaaacataaaagaggaaccaagcataagagccagggagacaaaaagacggtccaggcagaaagaaaagcacttccaaaggccctgaggcaggacagcatgtgacacgttggaggaaaaggaaggcctgtgaggttgcagtggggtgagaatgctgagttgagatgggcagggcccacgaaaatgaggctcacagctttgataccaaatgcaggaagattttattcagcttcttgaaatgatccagtttgcatagttttgtttttttttttttttttttgggagacrgagtctcgctctgtcacccaggctggagtgcaatggtgcaatctcggctcactgcaacctccacctcccgggttcaaacaattctcctgcctcaacctcccgagtagctggaattacaggcacatgccaccacgcctggctaatttttgtatttttagtagagatgaggtttcaccatgttggccaggctggtcttgaactcctgacctcaggtgacccacccacttcggcctcccaaagtgctgggattacaggcatgagccactgtgcccggcccaatttgcatgttttaaagagcat

SEQ ID NO: 79761 - DNA, 601 bp, Human
tgtggcccttccaccatgacaggtgctgtctctttacccaccatccacagacagccccgatgacatctttatacacccgcatcccttccttctggctactccaccttcatgctggggcaggaaaggggtcaatcaaaagccaccaaagctcagacagggaaacagcccagcactggaaccaggcagaagtcattgaaatccagatggagtgtgttaagactcaggcctacaatctgtggatgcatcccagggacccaggctttggggtgttccccagggcgtatgacctcccttacccctygctacagcccgaggagggaggcccggagaaacacgcccggcagggttatgcaactcacccacagccacagagacaggaagtgcaagagccactgctgaactcagggagtctggttccaaagtccacgctgcggaggacccccactggggcctctctgccttagcccaaggtcctacgctaggtggttctctgccctggacaagggtctccaactatggaatgcagccatgaacgagacagataaagtctctgtcctcatggaactcacacaagtggatgagataatttcagagactatta

SEQ ID NO: 79762 - DNA, 601 bp, Human
ttccattctaaataatgaaccttggcttaaatgctcagggagagaaacactcccagccccagccccatccaagacacctgatgggaccaagatgccaacaggaggatccctgcttcctcctggaggcaggaggtggccccagaaacagcctccacgcttcctgtggcccttccaccatgacaggtgctgtctctttacccaccatccacagacagccccgatgacatctttatacacccgcatcccttccttctggctactccaccttcatgctggggcaggaaaggggtcaatcaaaagycaccaaagctcagacagggaaacagcccagcactggaaccaggcagaagtcattgaaatccagatggagtgtgttaagactcaggcctacaatctgtggatgcatcccagggacccaggctttggggtgttccccagggcgtatgacctcccttaccccttgctacagcccgaggagggaggcccggagaaacacgcccggcagggttatgcaactcacccacagccacagagacaggaagtgcaagagccactgctgaactcagggagtctggttccaaagtccacgctgcggaggacc

SEQ ID NO: 79763 - DNA, 601 bp, Human
atgtaataatggcgcccggcctataaatggttccattctaaataatgaaccttggcttaaatgctcagggagagaaacactcccagccccagccccatccaagacacctgatgggaccaagatgccaacaggaggatccctgcttcctcctggaggcaggaggtggccccagaaacagcctccacgcttcctgtggcccttccaccatgacaggtgctgtctctttacccaccatccacagacagccccgatgacatctttatacacccgcatcccttccttctggctactccaccttcaygctggggcaggaaaggggtcaatcaaaagccaccaaagctcagacagggaaacagcccagcactggaaccaggcagaagtcattgaaatccagatggagtgtgttaagactcaggcctacaatctgtggatgcatcccagggacccaggctttggggtgttccccagggcgtatgacctcccttaccccttgctacagcccgaggagggaggcccggagaaacacgcccggcagggttatgcaactcacccacagccacagagacaggaagtgcaagagccactgctgaactcagggagt

SEQ ID NO: 79764 - DNA, 601 bp, Human
cacacctgtaatcccagcactttgggaggtcgaggtgggcggatcacctgaggtcaggagttcgagaccagcctggccaacatggagaaaccctgtctctactaaaaatacaaaattagctgggcacagtggcgcagcctgtaatcccagctacttgggaggctgaggtgagagaatcgcttgaacctgggaggcaaaggttgcggtgagccgagatcacaccattgcactccagcctgggcaacaagagagaaactccgtctcaaaataaataggtaagtaaatataagtaaatacatamataataaacagctggtaagctactacctcctcaagaggccttggtaaacagaatagtcagccaaacaaaataatctctaatactgtaacagccagagacagtgaaaggcaatgtggggatgaagtgggaagctacctgggggcaaaggggctcagccccatttttgctgcctatggccgcctcttcccccgacaacagcccctcctttttgccttttgggaaccaccctactcctacctgagtctctgtgggcaagaactacttccctccctggctccaaatgggcaggcgacccaaggc

SEQ ID NO: 79765 - DNA, 601 bp, Human
gcctgggatgctgctgggacacactgcagggtaaacccagtggctaggattccagatcaactcctccacgggtgcatctgggcagctcatccctcccacccctacctcatcccctctctgcccacggcacacccctgcagcctctcaccttgggtggacaaagcctgaactttggcacaccagccctgatatctccccaactttttaaaaaatgcctcatcccagtcctgccgccaggatgtgaacaggcaggggtatcaatgggaccctgggaactttctgcctgaagaacattcgttartgacttcctccggcacccacccaggccccttccacccttgctgcccgggccctcctggcctccatccagctagcctgggacagtcggccccacccagcactggctgctaactatctccgtggccttgagtaaacctctgctacctacagaatttggtttccaaaggaaaaataaaagatagaactgagcttcggaacccaagtcagtccagatctaacaatctgacagctgatgaaactttccccgttagagcaattaggccaggtacagtgattcatgaatgtaatcccagcactttgg

SEQ ID NO: 79766 - DNA, 601 bp, Human
ttgcagtgagctgagatcgcgccactgcactctagcctggccacacagcaagactccatctcaaaaaaaaaaaaaaaaaaaaaaaaaaaagacagatgaactgtgatactcagcttcttccgattagcatcatgaactgtgatatgacatggccatgaaaatagagtgcagcttatcgcagcaatgtgggtggatcccacaaataccatatgaagtaacaccagcaagaccaaaccaaacaaaaatactgagagtatgcctgcatccaagttaagtccaaaaccggaccaaactaatcccrgtgtttagggatggctatgagggagtgatactataaaaagcaaagcaagctgggaccaaacacagtgtcttctgcaggggcttcggggcagatgagctttccctcttcttcacgtggggtgattgcatgcatgttcatcttagttacatatttgattgcatatgtcttacactttcctcaaagtgagcaaatttcacaaaaaacagaaatccaagactctgggtggaaagtgcaaagcgaggggttgcagcaggtggagtccaggagcctgggaacagacagtggaaggaaatcccaagg

SEQ ID NO: 79767 - DNA, 601 bp, Human
ccactgcattccagcctgggtgacacagcaagactctgcctcaaaaaaaaaagaaatgtccagggccgggcacggtggctcaggcctgtaatcccaacactttgggaccaaggcaggtggatgacctgaggtcaggagtttgagactagcctggccaacatggtgaaacccgtctctactaaaaatacaaaaaaaaaaaattagccgggtgtggtgacaggcgcctgtagtcccagctactcgggaggctgaggcagaagaatcgcttgaacccgggaggcggaggttgcagtgagccaarattgcaccactgcactccagcctgggcgacagagcaagactctgtctcaaaaaaaaagaaagaaagaaagaaagaaatgtccgtaacaggtgcatctgtagagacagaaagaaaatgagtgattgccaggggctggggagctgcaaagagtggagaatgggcaattctacttgggagggatggaaatgttttgaaactaggtagaagtggtggtatcactgaattattcgatttacaaggattaattatatgttatgtgaatttgaactcaataaattattaaatgaaaaacaaatgata

SEQ ID NO: 79768 - DNA, 601 bp, Human
ggtcacacagcagcaggaggcagggccgggatctggacccacacctgcaggctccggaatctaggactgcacaaggtccaaggacacactcaggtttacagacgcagccacacagaggatgggcgcaggggcagggcgggctgaagagcgagaggggtgaggggaaggagggcataaaaggagaccactgaaagcagaagccaagcgagttcccgaacatgcgcgctcccagcagcaccgctcccggcagccaccagcccagacgcccatccacagaggcgcggaaaaacagcatgcagtscacccgcaccgtggaggcctgctcagctacaaaaaggaaagcagcactccacatgccacaccacggatgaaccccaaaacatgacgctaagcggaagcagccaggcacttaaggccacacattgcatgatttcatttataagaaatgtgcagggccgggcacggtggctcaggcctgtaatcccaacactttgggaccgaggcaggtgtttgacctgaggtcaggagtttgagaccagcctggccaacatgtgaaaccccgtctatattaaaaatacaaaaaaaaaaaaaaaaaaaaatt

SEQ ID NO: 79769 - DNA, 601 bp, Human
attggcgcggggggcagggcctttaaatcggtgattacgtttaaatgaggtcagtggggtgagccctaatccaatctgactgacgcccttaaaagaggagattaggacccgcagagagtcaccggggatgtgcgcacacagggagaaggtggcgtctatgaggccgggagaggggtctccggagaagccagccctgccaacatcctgatctcagacttccggtctccagaactgtacgggaatacatggtctttggcccatgcacctgttatggacatttttttctttctttctttctttyttttttttttttgagacagagtcctgctctgttgcccagactggagtgcagtggcacgatctcggctcactgcaacctctgcctcccatgcagactcagacacccaccagagaccagagactcgaagagcctgtccatggtcacacagcagcaggaggcagggccgggatctggacccacacctgcaggctccggaatctaggactgcacaaggtccaaggacacactcaggtttacagacgcagccacacagaggatgggcgcaggggcagggcgggctgaagagcgagaggggtgagg

SEQ ID NO: 79770 - DNA, 601 bp, Human
ccccaaaattcccatgttgcagccctaaccctcggtgcatcagaatgtgactgtattggcgcggggggcagggcctttaaatcggtgattacgtttaaatgaggtcagtggggtgagccctaatccaatctgactgacgcccttaaaagaggagattaggacccgcagagagtcaccggggatgtgcgcacacagggagaaggtggcgtctatgaggccgggagaggggtctccggagaagccagccctgccaacatcctgatctcagacttccggtctccagaactgtacgggaatacayggtctttggcccatgcacctgttatggacatttttttctttctttctttctttcttttttttttttgagacagagtcctgctctgttgcccagactggagtgcagtggcacgatctcggctcactgcaacctctgcctcccatgcagactcagacacccaccagagaccagagactcgaagagcctgtccatggtcacacagcagcaggaggcagggccgggatctggacccacacctgcaggctccggaatctaggactgcacaaggtccaaggacacactcaggtttacagacgcagc

SEQ ID NO: 79771 - DNA, 601 bp, Human
actattatgagctgaacagtgtccccccaaaattcccatgttgcagccctaaccctcggtgcatcagaatgtgactgtattggcgcggggggcagggcctttaaatcggtgattacgtttaaatgaggtcagtggggtgagccctaatccaatctgactgacgcccttaaaagaggagattaggacccgcagagagtcaccggggatgtgcgcacacagggagaaggtggcgtctatgaggccgggagaggggtctccggagaagccagccctgccaacatcctgatctcagacttccggyctccagaactgtacgggaatacatggtctttggcccatgcacctgttatggacatttttttctttctttctttctttcttttttttttttgagacagagtcctgctctgttgcccagactggagtgcagtggcacgatctcggctcactgcaacctctgcctcccatgcagactcagacacccaccagagaccagagactcgaagagcctgtccatggtcacacagcagcaggaggcagggccgggatctggacccacacctgcaggctccggaatctaggactgcacaaggtccaagga

SEQ ID NO: 79772 - DNA, 601 bp, Human
cagcatatttgctgtttgtggaggcaggagtcagacataaccaaggtacccccgtcgctaagggaataaatacaacaggatgaacatgaattagggggtccaggcagcagaaggaagcaataagcctgatacacacataggaacacggatagattttaaacagggcagcacgaggaatgttgacacgagttaccgtgcatggcatggaaaagccgccctctcctcagacgtgacaggccacatgaagggggcctccctgtgccacccccagctcaaagcacttccacctctagctccctcrgtcctcactgaatcctataggaaggcatggttttagcccattttataggcaccctactattatgagctgaacagtgtccccccaaaattcccatgttgcagccctaaccctcggtgcatcagaatgtgactgtattggcgcggggggcagggcctttaaatcggtgattacgtttaaatgaggtcagtggggtgagccctaatccaatctgactgacgcccttaaaagaggagattaggacccgcagagagtcaccggggatgtgcgcacacagggagaaggtggcgtctatgaggccgg

SEQ ID NO: 79773 - DNA, 601 bp, Human
tcaggtgctggagaggatgtgagagctgggagggtgaacagcagtggcccttctggaaggcatgttgggtgaaaatggctccccctctgccctacagcaattccactcctgcgcatccccaggaaattgtggagaagtacaaggcagcagggtccagcatatttgctgtttgtggaggcaggagtcagacataaccaaggtacccccgtcgctaagggaataaatacaacaggatgaacatgaattagggggtccaggcagcagaaggaagcaataagcctgatacacacataggaacacrgatagattttaaacagggcagcacgaggaatgttgacacgagttaccgtgcatggcatggaaaagccgccctctcctcagacgtgacaggccacatgaagggggcctccctgtgccacccccagctcaaagcacttccacctctagctccctcggtcctcactgaatcctataggaaggcatggttttagcccattttataggcaccctactattatgagctgaacagtgtccccccaaaattcccatgttgcagccctaaccctcggtgcatcagaatgtgactgtattggcgcggggg

SEQ ID NO: 79774 - DNA, 601 bp, Human
ggggagcagtgtcgtgctgtgatctttccagaaggctgactctttttccgtacacttttaatttgtttgatcatatccctattttaccttccttatttttaatgccagccagggctttctgggtaagagctgggcacacccagggagaggcacgtgaccatccgcagctgctctccttggcctccagtttgttttgtttttgtttcttactttctgtggagatggggggggggggtcttactatgttacccaggctggtcttgaactcctggcctcaggcgatcctcccacctctgcctcrctaagtgctgggattacaggcatgagccactgcgcctggccttgacttctggtttgtgagatggaagaacattggccccatgtgcagaggtggaaatcggcttttaggaaaaaagtgagtttccacaggacccaagtaatgggacctggatttgaacccagagctctgcagatctgaggattgggcacctgcacacatagtgctggtctgaagcatgtcccctgccaaattcatgcccacctagaacctcagaatgtggccttatttaaaaatagggtctctacagatgttaccaagtta

SEQ ID NO: 79775 - DNA, 601 bp, Human
acacttatctgcactcccaagccacagattacagctgtcaggcccagaggaaacgtggcggtcacatcaaccctgactctgaaaaaagccctgaaagacacaggggtgtttccagcacagcaaggtcttactggaaaggacccctggaccccaatgtcctagaggtgtgccccacgaccccacatgcccctcttcactgctctggcctttgggaaacacagccctgtcctttacaaggtcctatttgcaaagcctgctgggagacagaggcccagggctcggatgaggatgggttctgtgygggaacaagagatgccaagatccacctaggtgccccagccaagaggcagaaaagcatgggaaccgtgtgcccttgtgggacgtgtgccacggacgggaaggatacgggtgtgggtccccctctgtggacgcaaacatgtttattgcaggaaggaaaaacaaggaactattaacccaagtcacctctggagcaaagaccagctggggccaggggagcagtgtcgtgctgtgatctttccagaaggctgactctttttccgtacacttttaatttgtttgatcatatccctattttaccttc

SEQ ID NO: 79776 - DNA, 601 bp, Human
aggatgagtagctttccctgccacttcagccctgggggtccctcctcctcctcccacagtcctgtgtgccccattcaggtggttcataaacagctgcccggagcagattctccactggggtttgtcccatctgtaaaatgagggttgtaaatgtgcccaaacagctggggatgaatgcaaagcgccccacgccccgtgtcactcccagccaggagcaagagggcaccatgccagtgctgcctctggcccaggcagtcacctgtccaggggaaacaggcctctaaggctccaatggcctcamgcactggagttcatcaataacacaagccgagaaagccccaggaaagctggagacgctgccggaaatgcaaagctgctcattcttccatccgtcccagctaaaggggttcgaggaagctcctccccacacacctcccagggtggaaggggacctcatatctcagcggggctctggccctggccccagcatcccagtccctgtctcttctccctgcccccaccaaggacacagatgcccaggcctgctggcagcttcatcacacttatctgcactcccaagccacagattacagctgtcagg

SEQ ID NO: 79777 - DNA, 601 bp, Human
ggctgggcgcggtggctcacgcctgtaatcccagcactttgggaggccgaggtgggcggatcacgaggtcaggagattgagaccatgctggctaacacggtgaaaccccgtatctactaaaaatacaaaaaaattagccgggcgtggtggcgggcgcctgtagtcccagctacgcgggaggctgaggcaggagaatggcatgaaccagggaggcggagcttgcagtgagcggagattgcgccactgcactcccccgcctgggcaacagagcaagactccgtctcaaaaaaaaaaaaaaaaagagaattgcttgaactcgggaggcggaggttgcagtgagctgataccatgccactgcactccagcctgggcgacagagaaagactctgtctcaaaaaaaaaaaaaaaaaatactgagtcagatcatggctcttccctgctcagaaccctccatggaattgaaaaccaaatctgaactcctccaggtgtcctgcaaggcccccacatgcctgtcccctttcaccccctccagtcacttctcccaaccccactggcctgctccctcttcctccaacacagcaggctccttcgcacctccggc

SEQ ID NO: 79778 - DNA, 601 bp, Human
tgtagtggcacgcacgtgtaatcccagctactcagaaggctgaggcaagaaaattgcttgaggctgggcgcggtggctcacgcctgtaatcccagcactttgggaggccgaggtgggcggatcacgaggtcaggagattgagaccatgctggctaacacggtgaaaccccgtatctactaaaaatacaaaaaaattagccgggcgtggtggcgggcgcctgtagtcccagctacgcgggaggctgaggcaggagaatggcatgaaccagggaggcggagcttgcagtgagcggagattgcrccactgcactcccccgcctgggcaacagagcaagactccgtctcaaaaaaaaaaaaaaaaagagaattgcttgaactcgggaggcggaggttgcagtgagctgataccatgccactgcactccagcctgggcgacagagaaagactctgtctcaaaaaaaaaaaaaaaaaatactgagtcagatcatggctcttccctgctcagaaccctccatggaattgaaaaccaaatctgaactcctccaggtgtcctgcaaggcccccacatgcctgtcccctttcaccccctccagtcacttct

SEQ ID NO: 79779 - DNA, 601 bp, Human
ggatcacctgaggtcaggggttcaagaccagcctgcccaacatggtgaaacaccatctttacgaaaaatacaaaaattagccgagtgtagtggcacgcacgtgtaatcccagctactcagaaggctgaggcaagaaaattgcttgaggctgggcgcggtggctcacgcctgtaatcccagcactttgggaggccgaggtgggcggatcacgaggtcaggagattgagaccatgctggctaacacggtgaaaccccgtatctactaaaaatacaaaaaaattagccgggcgtggtggcgggygcctgtagtcccagctacgcgggaggctgaggcaggagaatggcatgaaccagggaggcggagcttgcagtgagcggagattgcgccactgcactcccccgcctgggcaacagagcaagactccgtctcaaaaaaaaaaaaaaaaagagaattgcttgaactcgggaggcggaggttgcagtgagctgataccatgccactgcactccagcctgggcgacagagaaagactctgtctcaaaaaaaaaaaaaaaaaatactgagtcagatcatggctcttccctgctcagaaccctccatg

SEQ ID NO: 79780 - DNA, 601 bp, Human
gcctggcccccgacactcccttctccagacagcagccagagagctcttcaagactgagtcaggctgggcgtggtggctcacacctgtaatcccagccctttgggaggccaaggcaggtggatcacctgaggtcaggggttcaagaccagcctgcccaacatggtgaaacaccatctttacgaaaaatacaaaaattagccgagtgtagtggcacgcacgtgtaatcccagctactcagaaggctgaggcaagaaaattgcttgaggctgggcgcggtggctcacgcctgtaatcccagcastttgggaggccgaggtgggcggatcacgaggtcaggagattgagaccatgctggctaacacggtgaaaccccgtatctactaaaaatacaaaaaaattagccgggcgtggtggcgggcgcctgtagtcccagctacgcgggaggctgaggcaggagaatggcatgaaccagggaggcggagcttgcagtgagcggagattgcgccactgcactcccccgcctgggcaacagagcaagactccgtctcaaaaaaaaaaaaaaaaagagaattgcttgaactcgggaggcggaggttgcagt

SEQ ID NO: 79781 - DNA, 601 bp, Human
tgttgagttgtcctcgcttgattttaggaccagagttaaggcccacactccatctgctctcaacctccctcccccgatcttctcgtctcggaaaatggctccaccatctaccaaactcctcaaaccttgaggaaccacccttgattcctctccttccctcgcaccccagtccactgacctatcttgttgactctccctgaaaaaaaactcgaatatgttcccttctttccatttagaaaactacccccacctggctcaaatcaccatcttctctgcctccccgcttccagcctggcccccracactcccttctccagacagcagccagagagctcttcaagactgagtcaggctgggcgtggtggctcacacctgtaatcccagccctttgggaggccaaggcaggtggatcacctgaggtcaggggttcaagaccagcctgcccaacatggtgaaacaccatctttacgaaaaatacaaaaattagccgagtgtagtggcacgcacgtgtaatcccagctactcagaaggctgaggcaagaaaattgcttgaggctgggcgcggtggctcacgcctgtaatcccagcactttgggaggcc

SEQ ID NO: 79782 - DNA, 601 bp, Human
cagctgcaccatcctacattcccaacagcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcatcctcaccccaacggcacacatgggccccgatttctccgcaycctcaccccaacggcacacatgggccccgatttctccgcacactcaccccaacggcacacatgggccccgatttctccgcatcctcaccccaacggcatacatgggccccgatttctccgcatcctcaccaatatttgagattttctgttttctcaagtgaccatcctaatgggtatgagtgtgtctcactgattctcatttccctaacgatgagcgagtgtcgctgagcacacttccatgtccccgttggctatctgcattttttttttttttaagacaggagtcttgctctgttgccc

SEQ ID NO: 79783 - DNA, 601 bp, Human
ttttccaggctgaatcctattccaacgtgtggatgggccccagcttcttacccaccacccatcagcggacactcgggttgctcccaccgttgggccatcgtgaacagcgctgcaatgaacgcggtggccagattcctcttcaagttcccacttccatttctttgatacccagaagtggggttgccccaccatatggtaattctatgttaaattttgggggggcctccacacagcagctgcaccatcctacattcccaacagcacacatgggccccgatttctccgcaccctcaccccaacrgcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcaccctcaccccaacggcacacatgggccccgatttctccgcatcctcaccccaacggcacacatgggccccgatttctccgcatcctcaccccaacggcacacatgggccccgatttctccgcacactcaccccaacggcacacatgggcc

SEQ ID NO: 79784 - DNA, 601 bp, Human
tgaagccagccaaggtcttgtaaaatagggcaacggtggtttgggcctggaggaatcagaagctcagggctgcctgcttcaaaggctaagtcttctgcaacaggctcagcatgttggaatttgaccctggccaacaggctgggccgtctggtctaccatctacaaaccaacagcccaacccattcaagcaggaggggccagtaccatttctcccttcaggttaaaccctgccacagtttttaattttaattggggtaaacataaaatttaccaacttagccttttttttttttttttttttgagatggagtctcggtctgtcacccaggctggagtgcagtggtgtgatctcagctcactgcaacctctgcctcccaggttcaagaaattctctgcctcagcctcctaagtagctgggattacaggcgcctgccaccatgccaggctaatttttgtatttttagtagagacggggtttcaccatcttggccaggctggtcttgaactcctgacctcgtgatccacccaccttgggctccaaaagtactgggattacaggcatgagccactacacgcccagcccaacttagccatttttaag

SEQ ID NO: 79785 - DNA, 601 bp, Human
tctgttgtgaagagggcacccggctataaacatgcctcagggaactattgttacacgagcctccctgagctcaccactggctccagttcaagaacacgtcatgaagccagccaaggtcttgtaaaatagggcaacggtggtttgggcctggaggaatcagaagctcagggctgcctgcttcaaaggctaagtcttctgcaacaggctcagcatgttggaatttgaccctggccaacaggctgggccgtctggtctaccatctacaaaccaacagcccaacccattcaagcaggaggggccrgtaccatttctcccttcaggttaaaccctgccacagtttttaattttaattggggtaaacataaaatttaccaacttagccttttttttttttttttttttgagatggagtctcggtctgtcacccaggctggagtgcagtggtgtgatctcagctcactgcaacctctgcctcccaggttcaagaaattctctgcctcagcctcctaagtagctgggattacaggcgcctgccaccatgccaggctaatttttgtatttttagtagagacggggtttcaccatcttggccaggctggtc

SEQ ID NO: 79786 - DNA, 601 bp, Human
tcacattttggtgttcataaatgcagtggcactggcccacagcggccacctcgacttatttctgtgtcgtcaatggcagcctcagcatcacagcagcagggctgagtagctgagacacaacccgtgcagcctgcagagctgagcatattgactatctgtctctgtacagaaaagcatgccaaccccagcctagaccacacagaaattcaggaagggccatcccctgccaggccagcttcacgggtgaggccggatctggccattagggagagggccagggcgcagacctagttctggcctyggctcagtcagcccctcccaccccggtcccctgatatgccacatggagacgtgactgcctccccatcctccccgtggcagtgcagagagaatgagatgacccaggacatgtgtctgttgtgaagagggcacccggctataaacatgcctcagggaactattgttacacgagcctccctgagctcaccactggctccagttcaagaacacgtcatgaagccagccaaggtcttgtaaaatagggcaacggtggtttgggcctggaggaatcagaagctcagggctgcctgcttcaaaggct

SEQ ID NO: 79787 - DNA, 601 bp, Human
ccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccccacaagctaacaatcattttgcattttcaaatggaaagaagggaaagaggggaagaaagggaagaaagaaaagaaagaaagaaggaaagaaagaaaggaaggaaggaaggaaggaaggaagggagaaraaagaaaagaaaggaaagaaaaagaaagaaaagaaaagaaaagaaaagaaaagaaaagaaaagaaaagaaaagaaaagaaagaaagtcagccagctgggtgcagtgctgcacgcctgtaatcccaacactttgggagaccaaggtggggagggtcactttgaggccaggagttcaagacgagcctgggcaacatagtgaggaccccccctacacacccacccaccaacctataaaaaaaaaaatgagccaggcgtggtggcacatgcctgttgtcccagctactcaggagagtaaggtgg

SEQ ID NO: 79788 - DNA, 601 bp, Human
aaaaacaatttctaccagggctgatcccagccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccccacaagctaacaatcattttgcattttcaaatggaaagaagggaaagaggggaagaaagggaagaaagaaaagaaagaaagaaggaaagaaagaaagraaggaaggaaggaaggaaggaagggagaagaaagaaaagaaaggaaagaaaaagaaagaaaagaaaagaaaagaaaagaaaagaaaagaaaagaaaagaaaagaaaagaaagaaagtcagccagctgggtgcagtgctgcacgcctgtaatcccaacactttgggagaccaaggtggggagggtcactttgaggccaggagttcaagacgagcctgggcaacatagtgaggaccccccctacacacccacccaccaacctataaaaaaaaaaatgagccaggcgtggtggcacatgcctg

SEQ ID NO: 79789 - DNA, 601 bp, Human
acaaaaacaatttctaccagggctgatcccagccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccccacaagctaacaatcattttgcattttcaaatggaaagaagggaaagaggggaagaaagggaagaaagaaaagaaagaaagaaggaaagaaagaaaggaaggaaggaaggaaggaaggaagggagaagaaagaaaagaaaggaaagaaaaagaaagaaaagaaaagaaaagaaaagaaaagaaaagaaaagaaaagaaaagaaaagaaagaaagtcagccagctgggtgcagtgctgcacgcctgtaatcccaacactttgggagaccaaggtggggagggtcactttgaggccaggagttcaagacgagcctgggcaacatagtgaggaccccccctacacacccacccaccaacctataaaaaaaaaaatgagccaggcgtggtggcacatgcc

SEQ ID NO: 79790 - DNA, 601 bp, Human
tgaaataaaataaaatagaataaagctaataattcgtctccattttactgatgaagaaagtgaagtacagggagattaaaccactcgcttgcccaagagcacaaacccaatgttggcacagagtcttgaccttgggtctgaccaaaggctgggcactgccttggtaaaggcccagcacaggcgtggcaagtaaggagctcagaccagcgaagagaatgctggaaggtgcatacagtcctggtccccgggcacagagatgaatcaagcacaatctctccttccccgccaaatcagggcctcwtcctgctccccagttgcacctgcatgacgggaactccaggcagcccacctctacttgcttttttggacaaaaacaatttctaccagggctgatcccagccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccccacaagctaacaatcattttgcattttca

SEQ ID NO: 79791 - DNA, 601 bp, Human
acagagcaagaccctgtctcaaaataaaatgaaataaaataaaatagaataaagctaataattcgtctccattttactgatgaagaaagtgaagtacagggagattaaaccactcgcttgcccaagagcacaaacccaatgttggcacagagtcttgaccttgggtctgaccaaaggctgggcactgccttggtaaaggcccagcacaggcgtggcaagtaaggagctcagaccagcgaagagaatgctggaaggtgcatacagtcctggtccccgggcacagagatgaatcaagcacaayctctccttccccgccaaatcagggcctcatcctgctccccagttgcacctgcatgacgggaactccaggcagcccacctctacttgcttttttggacaaaaacaatttctaccagggctgatcccagccccactgtttccacacaagtcagacagtgaatatgccttctttcaaacaccccaacctcaataaagctggctgttttcaagcaaaaacattattcttctctgttcttagaaaggtttcaacaagctacagcctgtggaccaaatccagcctgatgcctatttctactcaccc

SEQ ID NO: 79792 - DNA, 601 bp, Human
gtggaaggctgaggcaggaggatcccttgagcccaggagatagaggctgcagtgagccatgatcgtgccactgtactccagcctgggtgacagagcaagaccctgtctcaaaataaaatgaaataaaataaaatagaataaagctaataattcgtctccattttactgatgaagaaagtgaagtacagggagattaaaccactcgcttgcccaagagcacaaacccaatgttggcacagagtcttgaccttgggtctgaccaaaggctgggcactgccttggtaaaggcccagcacaggcrtggcaagtaaggagctcagaccagcgaagagaatgctggaaggtgcatacagtcctggtccccgggcacagagatgaatcaagcacaatctctccttccccgccaaatcagggcctcatcctgctccccagttgcacctgcatgacgggaactccaggcagcccacctctacttgcttttttggacaaaaacaatttctaccagggctgatcccagccccactgtttccacacaagtcagacagtgaatatgccttctttcaaacaccccaacctcaataaagctggctgttttcaagca

SEQ ID NO: 79793 - DNA, 601 bp, Human
atttgccaaatgtggtagtgtatgcctgtagacccaggtacgtggaaggctgaggcaggaggatcccttgagcccaggagatagaggctgcagtgagccatgatcgtgccactgtactccagcctgggtgacagagcaagaccctgtctcaaaataaaatgaaataaaataaaatagaataaagctaataattcgtctccattttactgatgaagaaagtgaagtacagggagattaaaccactcgcttgcccaagagcacaaacccaatgttggcacagagtcttgaccttgggtctgaacaaaggctgggcactgccttggtaaaggcccagcacaggcgtggcaagtaaggagctcagaccagcgaagagaatgctggaaggtgcatacagtcctggtccccgggcacagagatgaatcaagcacaatctctccttccccgccaaatcagggcctcatcctgctccccagttgcacctgcatgacgggaactccaggcagcccacctctacttgcttttttggacaaaaacaatttctaccagggctgatcccagccccactgtttccacacaagtcagacagtgaatatgccttctt

SEQ ID NO: 79794 - DNA, 601 bp, Human
agccccatctctacaaaaaatgtttaaaaatttgccaaatgtggtagtgtatgcctgtagacccaggtacgtggaaggctgaggcaggaggatcccttgagcccaggagatagaggctgcagtgagccatgatcgtgccactgtactccagcctgggtgacagagcaagaccctgtctcaaaataaaatgaaataaaataaaatagaataaagctaataattcgtctccattttactgatgaagaaagtgaagtacagggagattaaaccactcgcttgcccaagagcacaaacccaatgktggcacagagtcttgaccttgggtctgaccaaaggctgggcactgccttggtaaaggcccagcacaggcgtggcaagtaaggagctcagaccagcgaagagaatgctggaaggtgcatacagtcctggtccccgggcacagagatgaatcaagcacaatctctccttccccgccaaatcagggcctcatcctgctccccagttgcacctgcatgacgggaactccaggcagcccacctctacttgcttttttggacaaaaacaatttctaccagggctgatcccagccccactgtttcca

SEQ ID NO: 79795 - DNA, 601 bp, Human
ttgtttccagctcaaagcatcccatttaaagcaatgctttcatttatttaaacctaacaattaggctgggtgtggtggctcacacctgtaatcccagcactttgggaggctggggcaggaggatcactggagcccaggagttcgagaccagcctgcgcaacacagtgagccccatctctacaaaaaatgtttaaaaatttgccaaatgtggtagtgtatgcctgtagacccaggtacgtggaaggctgaggcaggaggatcccttgagcccaggagatagaggctgcagtgagccatgatygtgccactgtactccagcctgggtgacagagcaagaccctgtctcaaaataaaatgaaataaaataaaatagaataaagctaataattcgtctccattttactgatgaagaaagtgaagtacagggagattaaaccactcgcttgcccaagagcacaaacccaatgttggcacagagtcttgaccttgggtctgaccaaaggctgggcactgccttggtaaaggcccagcacaggcgtggcaagtaaggagctcagaccagcgaagagaatgctggaaggtgcatacagtcctggtcccc

SEQ ID NO: 79796 - DNA, 601 bp, Human
ctgctgaacgcatctggaaaccaccacctcccatctctcaggaagcacaacagtaaacatctgcattacagaagccactggaggcaagttttatgttgtttccagctcaaagcatcccatttaaagcaatgctttcatttatttaaacctaacaattaggctgggtgtggtggctcacacctgtaatcccagcactttgggaggctggggcaggaggatcactggagcccaggagttcgagaccagcctgcgcaacacagtgagccccatctctacaaaaaatgtttaaaaatttgccaartgtggtagtgtatgcctgtagacccaggtacgtggaaggctgaggcaggaggatcccttgagcccaggagatagaggctgcagtgagccatgatcgtgccactgtactccagcctgggtgacagagcaagaccctgtctcaaaataaaatgaaataaaataaaatagaataaagctaataattcgtctccattttactgatgaagaaagtgaagtacagggagattaaaccactcgcttgcccaagagcacaaacccaatgttggcacagagtcttgaccttgggtctgaccaaaggctg

SEQ ID NO: 79797 - DNA, 601 bp, Human
cacacgatgagaacgtggcattcattcattcattcattcactcagtcattcattcatttcaaccctgcctgagcatccaaagcgggcgatcagtgctacaggggtaaagttaatccaacaggattcctgccctcgtggactgagcaggaagtggggaagaggacacgcaattcacaagtgactcaggtacccagtaggaagagctcagggacatcacacgtattcactggcacgcactggcaagcaccagaggtctcgcgcatgtgtcactggccagaatgtccatcagtacagccacctyggagagccactgggcaaaatctactgaggcagagcacgatgttctgaactgctgaacgcatctggaaaccaccacctcccatctctcaggaagcacaacagtaaacatctgcattacagaagccactggaggcaagttttatgttgtttccagctcaaagcatcccatttaaagcaatgctttcatttatttaaacctaacaattaggctgggtgtggtggctcacacctgtaatcccagcactttgggaggctggggcaggaggatcactggagcccaggagttcgagaccagcctgcg

SEQ ID NO: 79798 - DNA, 601 bp, Human
tgcaatccctgtcctatagtaacacacgatgagaacgtggcattcattcattcattcattcactcagtcattcattcatttcaaccctgcctgagcatccaaagcgggcgatcagtgctacaggggtaaagttaatccaacaggattcctgccctcgtggactgagcaggaagtggggaagaggacacgcaattcacaagtgactcaggtacccagtaggaagagctcagggacatcacacgtattcactggcacgcactggcaagcaccagaggtctcgcgcatgtgtcactggccagartgtccatcagtacagccacctcggagagccactgggcaaaatctactgaggcagagcacgatgttctgaactgctgaacgcatctggaaaccaccacctcccatctctcaggaagcacaacagtaaacatctgcattacagaagccactggaggcaagttttatgttgtttccagctcaaagcatcccatttaaagcaatgctttcatttatttaaacctaacaattaggctgggtgtggtggctcacacctgtaatcccagcactttgggaggctggggcaggaggatcactggagccc

SEQ ID NO: 79799 - DNA, 601 bp, Human
gcaaagcaggagccgcttcacagttggggtgtgccctccagcttgcaacgggccccaccactccctatcacctcatgccagggcccttcccccatgtatgttcctgcacagtttgcaatccctgtcctatagtaacacacgatgagaacgtggcattcattcattcattcattcactcagtcattcattcatttcaaccctgcctgagcatccaaagcgggcgatcagtgctacaggggtaaagttaatccaacaggattcctgccctcgtggactgagcaggaagtggggaagaggacaygcaattcacaagtgactcaggtacccagtaggaagagctcagggacatcacacgtattcactggcacgcactggcaagcaccagaggtctcgcgcatgtgtcactggccagaatgtccatcagtacagccacctcggagagccactgggcaaaatctactgaggcagagcacgatgttctgaactgctgaacgcatctggaaaccaccacctcccatctctcaggaagcacaacagtaaacatctgcattacagaagccactggaggcaagttttatgttgtttccagctcaaagcatcc

SEQ ID NO: 79800 - DNA, 601 bp, Human
ccaaatcagtgcctcaccgaatcatattacagcttcaagcaaaaggaaaaaatgtgcaccccatatttatactttttccagaacattaaagtctttttgtaaaaacactgacaatttcaaaagttcacatattaacacaacattattttaagtttaaatattttatttaagcccacccaaaccagattatactatcatgttaatgacctggctttaatggaagcattttcattgtattagcttcccactgctgctgtaagaattaacaattaacactggctcagatcaatacaaagttatyatcttacagttctcggggggagaagtccaaactgggactgcccctgagatgggatgaaagtcacggtgcaggcagggtgcttccttctggagctcagggggaatccattgccttccgtttcccagcttctaagaggcctctgcattccttggctcctgtccccttatcactccaacccctgcttctgaggtcacatctcctactctgaccctcctgcctccctctgtcaaagatccttgtgaaagcattgtggcccctgggacaatccaagttcatctcccatctcaagatccttaactt

SEQ ID NO: 79801 - DNA, 601 bp, Human
agaaagttattttaaaacaagcaggctctgtcgcggcaatacagggagggccaaatcagtgcctcaccgaatcatattacagcttcaagcaaaaggaaaaaatgtgcaccccatatttatactttttccagaacattaaagtctttttgtaaaaacactgacaatttcaaaagttcacatattaacacaacattattttaagtttaaatattttatttaagcccacccaaaccagattatactatcatgttaatgacctggctttaatggaagcattttcattgtattagcttcccactgmtgctgtaagaattaacaattaacactggctcagatcaatacaaagttatcatcttacagttctcggggggagaagtccaaactgggactgcccctgagatgggatgaaagtcacggtgcaggcagggtgcttccttctggagctcagggggaatccattgccttccgtttcccagcttctaagaggcctctgcattccttggctcctgtccccttatcactccaacccctgcttctgaggtcacatctcctactctgaccctcctgcctccctctgtcaaagatccttgtgaaagcattg

SEQ ID NO: 79802 - DNA, 601 bp, Human
cccagctacttgggaggctgaggaaggagaatcacttgaacctggaaggcagaggttctagtgagccgagattgtgccactgcactccagcctgggcgacagagtgagacttggtctcaaaaaaaaaaaaaactgttctaaaacagaaagttattttaaaacaagcaggctctgtcgcggcaatacagggagggccaaatcagtgcctcaccgaatcatattacagcttcaagcaaaaggaaaaaatgtgcaccccatatttatactttttccagaacattaaagtctttttgtaaaaacrctgacaatttcaaaagttcacatattaacacaacattattttaagtttaaatattttatttaagcccacccaaaccagattatactatcatgttaatgacctggctttaatggaagcattttcattgtattagcttcccactgctgctgtaagaattaacaattaacactggctcagatcaatacaaagttatcatcttacagttctcggggggagaagtccaaactgggactgcccctgagatgggatgaaagtcacggtgcaggcagggtgcttccttctggagctcagggggaatcc

SEQ ID NO: 79803 - DNA, 601 bp, Human
gaggccaaggcaggtggatcacttgaggtcaggagttggagactagcctggccaacatagtgaaatcccgactctactaaaagtacaaaaattagccaggtgtggtgtcaggcacctgtggtcccagctacttgggaggctgaggaaggagaatcacttgaacctggaaggcagaggttctagtgagccgagattgtgccactgcactccagcctgggcgacagagtgagacttggtctcaaaaaaaaaaaaaactgttctaaaacagaaagttattttaaaacaagcaggctctgtcgcrgcaatacagggagggccaaatcagtgcctcaccgaatcatattacagcttcaagcaaaaggaaaaaatgtgcaccccatatttatactttttccagaacattaaagtctttttgtaaaaacactgacaatttcaaaagttcacatattaacacaacattattttaagtttaaatattttatttaagcccacccaaaccagattatactatcatgttaatgacctggctttaatggaagcattttcattgtattagcttcccactgctgctgtaagaattaacaattaacactggctcaga

SEQ ID NO: 79804 - DNA, 601 bp, Human
gcaatccaggtcatccaaagccaggaaagtctgagaacccacagagaccagaggatcctaaggcaacgtgagggacaaacgcaatgtggggccctggattgggtcctgggacagaaaatgatacgaaggagaaacgaaggaaacgtgaatcctgtctggatgttagttattactgatgtatcaacactgggtcattcatagcaacaaatgtatcccattcctttaagatgttaatagcaggggacactggctgtgggatatgtgggaactcagcactatcttcccaatttttctgaaagtygaactgttctaggccgggcgcggtggctcacacctgtggaatcctagcactttgggaggccaaggcaggtggatcacttgaggtcaggagttggagactagcctggccaacatagtgaaatcccgactctactaaaagtacaaaaattagccaggtgtggtgtcaggcacctgtggtcccagctacttgggaggctgaggaaggagaatcacttgaacctggaaggcagaggttctagtgagccgagattgtgccactgcactccagcctgggcgacagagtgagacttggtctcaaaaa

SEQ ID NO: 79805 - DNA, 601 bp, Human
caaaattcctagccggtgctcaggaacgcaatccaggtcatccaaagccaggaaagtctgagaacccacagagaccagaggatcctaaggcaacgtgagggacaaacgcaatgtggggccctggattgggtcctgggacagaaaatgatacgaaggagaaacgaaggaaacgtgaatcctgtctggatgttagttattactgatgtatcaacactgggtcattcatagcaacaaatgtatcccattcctttaagatgttaatagcaggggacactggctgtgggatatgtgggaactcagyactatcttcccaatttttctgaaagtcgaactgttctaggccgggcgcggtggctcacacctgtggaatcctagcactttgggaggccaaggcaggtggatcacttgaggtcaggagttggagactagcctggccaacatagtgaaatcccgactctactaaaagtacaaaaattagccaggtgtggtgtcaggcacctgtggtcccagctacttgggaggctgaggaaggagaatcacttgaacctggaaggcagaggttctagtgagccgagattgtgccactgcactccagcctggg

SEQ ID NO: 79806 - DNA, 601 bp, Human
gatccaggggtgggtactcttcagatgttcaatacaccctcaagtggtgtcgctaataagagagcacctacagccaccaaggcccaatcagggtcccagtgccccgtcaaatctgatttctgaagcagagcagcgaggccagccaggagaccaccaggggccctggagagacgtgagaggtctggggtcccctctttaccagcaaaggggctctgtccactccctgtcccctcaaccccctgcccatcctccacctaccagcaggcgcctgatacaacttcctgtgcctgtttctttaccygtaacaaggaataaagaataggacccatgcagcagggacaggtcatgttgacataatgtgctgggaacagcccttcgtcactgcgatcttccttccaaaacccggaactagggcctaatcaatagaagaacaacagacaaatcccagcagaggggcgtcctgcaaaattcctagccggtgctcaggaacgcaatccaggtcatccaaagccaggaaagtctgagaacccacagagaccagaggatcctaaggcaacgtgagggacaaacgcaatgtggggccctggattgggtcctggga

SEQ ID NO: 79807 - DNA, 601 bp, Human
cacactggccttgctgtgctcctgagccaccaggcaagtttctgccacagggcctttgcactgactctttgctcctccaggggcaatctttcccctgatgcccacaaaagtgagcccctcacttctcaagtctaaagtcactttctccgtgagaccttccctgagcaattttcaatcccttaaccatctctattgagccccactgtatggcaggctctgctctaggcctgggcacttcaatagtgaacaaaatggatgaaaataccattcttcctaaagcagcccttcccccatcacattrtattcatcaccctgttttatctccctgacattatcaatatctgaaatttctatgtagttgttgataagtcccccttcctgctgcccggaattcagtcacaatggatggagctagagcagccatcttggatcatgaggcacccttaagaatgaaagccacacatgaagaagggcggagcagaataggagataggagaaaggattcctgtgacttcctggagccacccaccagccctgggtggcttagtcatcagagaaatgtccactggactcacagtgagatcccatgccatacaccaga

SEQ ID NO: 79808 - DNA, 601 bp, Human
acccttggctcatgttccaacttcttttgatttttaaaggactaaggtaagaagactaaaataaaaggtttttacaagaaacccacgcttgtaagttgcttaagcgaagaggttgagtcattcctgagtcctccattttcctcccacctagcaccctccatcagcaaggctgggctgctctcgctttaaagcatgcctcaaatccatccacttctctccaacaccatcctggcccccatcctggcttgtatggatgggtgccgtagtttccctgctgttttcctgcctctgctcttgcccmccgccccgttctccccacagaatccaagttatccttttaagattaaagtcagagcatgtcattctgctcaaacctcccccatgcctccctatttatctcagaatagaatctaaattcctgacagtgacctatgaggtcttgcacaacccagctccctatagtcactccagtctcctcccccattcctatctgcctcgctcactctgctccagccacactggccttgctgtgctcctgagccaccaggcaagtttctgccacagggcctttgcactgactctttgctcctccaggggcaat

SEQ ID NO: 79809 - DNA, 601 bp, Human
aatccaatctgggacttgggaacaccacacccttggctcatgttccaacttcttttgatttttaaaggactaaggtaagaagactaaaataaaaggtttttacaagaaacccacgcttgtaagttgcttaagcgaagaggttgagtcattcctgagtcctccattttcctcccacctagcaccctccatcagcaaggctgggctgctctcgctttaaagcatgcctcaaatccatccacttctctccaacaccatcctggcccccatcctggcttgtatggatgggtgccgtagtttcccygctgttttcctgcctctgctcttgccccccgccccgttctccccacagaatccaagttatccttttaagattaaagtcagagcatgtcattctgctcaaacctcccccatgcctccctatttatctcagaatagaatctaaattcctgacagtgacctatgaggtcttgcacaacccagctccctatagtcactccagtctcctcccccattcctatctgcctcgctcactctgctccagccacactggccttgctgtgctcctgagccaccaggcaagtttctgccacagggcctttgc

SEQ ID NO: 79810 - DNA, 601 bp, Human
aaattctcaatggctcatctcatcgaagcagacactgaggctccaaagccaaatgcctgaccaaggtcacaggagcagggagagacagagccccaggctccgtatccacgtctaggcctgtgccctcacgcttctctcctaggccatccccgctgggctccttgcacgggagcttcacaaatgaatcattaacttgacctggccactgaattgcaaggtctaattcctcctcctatgagaagagaaaacaggcttccaagaaacacacctctgaccaaatgagccaagaagccaatttgcycagacgaagcctagttctgggacaaggccaggccctgcccactctggaccagcagtcagtggctgactacactctcaatcccagggctccaggcatccccagctccatggggccttaagatgcaggaacaactacgacacaggctaatccaatctgggacttgggaacaccacacccttggctcatgttccaacttcttttgatttttaaaggactaaggtaagaagactaaaataaaaggtttttacaagaaacccacgcttgtaagttgcttaagcgaagaggttgagtcattcctga

SEQ ID NO: 79811 - DNA, 601 bp, Human
tttagcattctcttcctaccacccacagcactctcccctgcacctggagaggcccctgacctccaaacctaacaccccgctcgcccaggtgccacctcctccatgaagcccactggaacgacctcggcctacagtgaggctgctctgacctcattgggattgcagttcatgccctgtacaatcatccgccccatgctagatgctatgctaggaatttaaagacacagggatgaacacgatggggcccctgccctgagacgcccctgccctcagacaccaggggagcggaatcgtctggacratctgcccggccctgttcaggtagcgaaacacttccacctacttcacctcttaaattctcaatggctcatctcatcgaagcagacactgaggctccaaagccaaatgcctgaccaaggtcacaggagcagggagagacagagccccaggctccgtatccacgtctaggcctgtgccctcacgcttctctcctaggccatccccgctgggctccttgcacgggagcttcacaaatgaatcattaacttgacctggccactgaattgcaaggtctaattcctcctcctatgagaagagaaaa

SEQ ID NO: 79812 - DNA, 601 bp, Human
catagacattaatttttagcattctcttcctaccacccacagcactctcccctgcacctggagaggcccctgacctccaaacctaacaccccgctcgcccaggtgccacctcctccatgaagcccactggaacgacctcggcctacagtgaggctgctctgacctcattgggattgcagttcatgccctgtacaatcatccgccccatgctagatgctatgctaggaatttaaagacacagggatgaacacgatggggcccctgccctgagacgcccctgccctcagacaccaggggagcrgaatcgtctggacaatctgcccggccctgttcaggtagcgaaacacttccacctacttcacctcttaaattctcaatggctcatctcatcgaagcagacactgaggctccaaagccaaatgcctgaccaaggtcacaggagcagggagagacagagccccaggctccgtatccacgtctaggcctgtgccctcacgcttctctcctaggccatccccgctgggctccttgcacgggagcttcacaaatgaatcattaacttgacctggccactgaattgcaaggtctaattcctcctcct

SEQ ID NO: 79813 - DNA, 601 bp, Human
aaggctcatccaacctgcccctaaaactcctgacctcccgacctgccgtgttgtttccatgctgcttgtggccttcgagcacacggtataattagcttatcaggtttattgctgtccatctgtatcacctgcctggccataaacccacaagggcaagatcctcagctgctttgtttggcgatgtgtctgtcctcagggcctgggacagctcttggcaccttgcaggagctctgtaaatattttctgggtgaatgagcaaaagtgagacctgaaaccatataatcaacgtggaaatgtctascgggtggtaacgctagtcctcctttgtgtgttttaaacagctcatacttaagaagggatttttttttttttaaatacacagagagtaccgcctgtttaggccggggcaacaactcggtaaatgtgtgatggatgagatgaagatttcatagacattaatttttagcattctcttcctaccacccacagcactctcccctgcacctggagaggcccctgacctccaaacctaacaccccgctcgcccaggtgccacctcctccatgaagcccactggaacgacctcggcctacagtgaggc

SEQ ID NO: 79814 - DNA, 601 bp, Human
cgacctgcacacccaccagaagcctcatgagggaatacgcaccttcccagcatgatgcaacttacgttatgactccattattcgcccctctggtattctatcctattccattctgtttttaaaatgctgatcccaggccaggtgcagtggctcatgcctgtaatcccagcactttgggaggctggggcgggcaaatcatgaggtcaggagatcgagatcatcctggccaacacagtgaaaccctgtctctactaacaatacaaaaaaattagccaggcgtggtggcagatgcctgtagtcycagctactcgggtggctgaggcaggagaatcgcttgaatccaggaggcggaggttgcagcgagccaaaattgcgccactgcactccagcctgggcaacagagcgagactccatctcaaaaaaaaaaaaaaaaaaaaaagctgatccccacccaccccacttatttcacaacccacaatctgatcacatctgacagtttgaaaactctgccctagaaagattctcctaagtgtgcaagaaagcgccagaagaattgtcagacctcaaaaaaagaacagagggccaggcacgggggctcacg

SEQ ID NO: 79815 - DNA, 601 bp, Human
cgctgtgcacagcgggggtcaggccactggggagtcgggacagtttctaatcgggtcaggtgtgagcaaagccccatggtctgtgggttccctgttcagacatggtgcagagcaccagcttcccagctcctgccaggctagggccacgacctgcacacccaccagaagcctcatgagggaatacgcaccttcccagcatgatgcaacttacgttatgactccattattcgcccctctggtattctatcctattccattctgtttttaaaatgctgatcccaggccaggtgcagtggctcaygcctgtaatcccagcactttgggaggctggggcgggcaaatcatgaggtcaggagatcgagatcatcctggccaacacagtgaaaccctgtctctactaacaatacaaaaaaattagccaggcgtggtggcagatgcctgtagtcccagctactcgggtggctgaggcaggagaatcgcttgaatccaggaggcggaggttgcagcgagccaaaattgcgccactgcactccagcctgggcaacagagcgagactccatctcaaaaaaaaaaaaaaaaaaaaaagctgatccccacccac

SEQ ID NO: 79816 - DNA, 601 bp, Human
tgtggtggctcacatctgtaatcccagcactttgggaggctgaggcaagtggatcacctgaggtcaggagttcaagaccagcctggccaacatggtgaaaccccgcctctattaaaaaaaaaaaaaatgcaaaaattagctgggcatggtggcagccaactgtattcccagctactcgggaggctgaggcaggagaatcgcttgaacccgggaggcggaggttgcagtgagagccgagatcgcgccactgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgaccacacttacgaaatgcccagaataggcaaatccagagacagcagattggtggttgccaggggctggggcagaaaggaatggtgggtgactgcttaatgggtacacggtaatgagaatgctttggaactagatcgtggtaacgattgcgcaaccttgcgaacgcactaaatgccactaaa

SEQ ID NO: 79817 - DNA, 601 bp, Human
aaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaaaaaaaatgcaaaaattagctgggcatggtggcagccaactgtattcccagctactcgggaggctgaggcaggagaatcgcttgaacccgggaggcggaggttgcagtgagagccgagatcgcgccrctgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgaccacacttacgaaatgcccagaataggcaaatccagagacagcagattggtggttgccaggggctggggcagaaaggaatggtgggtgactgcttaatgggtacacggtaatgagaatgctttgga

SEQ ID NO: 79818 - DNA, 601 bp, Human
cccaagagtccgtcaacagatgaatggctgaacgcagtgtggtctgtccagacagcggcatctgactcacttagaaaaaggaatgcatgggttggctgtttactactgcgtaaaaaagaaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaaaaaaaatrcaaaaattagctgggcatggtggcagccaactgtattcccagctactcgggaggctgaggcaggagaatcgcttgaacccgggaggcggaggttgcagtgagagccgagatcgcgccactgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgaccacactt

SEQ ID NO: 79819 - DNA, 601 bp, Human
cgacccaagagtccgtcaacagatgaatggctgaacgcagtgtggtctgtccagacagcggcatctgactcacttagaaaaaggaatgcatgggttggctgtttactactgcgtaaaaaagaaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaaaaaawatgcaaaaattagctgggcatggtggcagccaactgtattcccagctactcgggaggctgaggcaggagaatcgcttgaacccgggaggcggaggttgcagtgagagccgagatcgcgccactgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgaccaca

SEQ ID NO: 79820 - DNA, 601 bp, Human
aacgacccaagagtccgtcaacagatgaatggctgaacgcagtgtggtctgtccagacagcggcatctgactcacttagaaaaaggaatgcatgggttggctgtttactactgcgtaaaaaagaaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaaaawaaatgcaaaaattagctgggcatggtggcagccaactgtattcccagctactcgggaggctgaggcaggagaatcgcttgaacccgggaggcggaggttgcagtgagagccgagatcgcgccactgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgacca

SEQ ID NO: 79821 - DNA, 601 bp, Human
aaaacgacccaagagtccgtcaacagatgaatggctgaacgcagtgtggtctgtccagacagcggcatctgactcacttagaaaaaggaatgcatgggttggctgtttactactgcgtaaaaaagaaatgtatttaaagagccaaaaaaaataattttaaagaaaggaatgcggccaggtgtggtggctcacatctgtaatcccagcactttgggaggctgaggcaagtggatcacctgaggtcaggagttcaagaccagcctggccaacatggtgaaaccccgcctctattaaaaaaaawaaaaatgcaaaaattagctgggcatggtggcagccaactgtattcccagctactcgggaggctgaggcaggagaatcgcttgaacccgggaggcggaggttgcagtgagagccgagatcgcgccactgcactccagcctgggtaacagaccgagatttcatctcaaaaaaaaaaaaaaagagaaagaaagaaagaaaaagaaaggaatgcaacactgacacatgccaccacatggacaaacctcaaaaacctgacatggagtgaaagaagccagtcaaaaggccacacttagtgtctgac

SEQ ID NO: 79822 - DNA, 601 bp, Human
catggcggctcccaccaccccatgcgaccacagcccacaggcaccagctccagcccctcccagctctcaggccccgatcgcccagcccttccttcagtcctggccttcacccagcctcaaagcccatgcactgcaggtccctctgtctgggacagaccctgcagccctggggaccctgctcaccacaggccagaccccttcaccagcctgggggacacatccagctgctggtgctccccccatagaaaacacagcatcaaaacccagaaccctggaaaatgtgttcggggagtagagcacraactatatgttctcaccacagaaaacagtggggggcaggagggaaccgtagaggtgacaggtatgttcagcacctggatctcaggggcgggtttcccggtgtgcacacaccagcccatcaaactgcatatattaaatatgtgccattgttttatatcaatcacaccttaataaagctgcttttttaaaaaagcaaaacaaggcccagtgcggtggctcacacctgtaatcccagcactttgaggggccgaggcaggcagatcacttgagcacaggagttcaagaccagcctgagcatgga

SEQ ID NO: 79823 - DNA, 601 bp, Human
aaagaaatgtatatgaaatctcctgatttaaaaatgttgcaaaaacatggttttcttaaagggactataggaaacacgcctggggtccacttggactcctctgccagctttcctcctctagatctataattcgctgccccagtgtcacagggaggtcccccctagtccacctgacccccaccctcaacccagccgggacatatctcgggcccctcagtgcccacaccacgtcagagcccggcaggagtgacccagcccattagactagagctgatgtcgcaaagccaggcagctgcgtcaycttccaccctcttttgaacatggccttctaagacaaggacagccagaaccaacaggcagaggctctacaggaggcagacagctgagctggccagtcagggccagccccatgtcccccggaaggagcagatttggaggcagccagaccctgggtcgcactccacggggccacttgggcaagtcagcccctgtgaacctcaagtttctcatctgtacgaaggagctagtgacactgtagctacaactgtgtctagtttgacctacgtggcgtgtcaatgaagaagctgaattctttgtcaag

SEQ ID NO: 79824 - DNA, 601 bp, Human
agaacacagaagttttccatgaaaaccagaaataaagaaatgtatatgaaatctcctgatttaaaaatgttgcaaaaacatggttttcttaaagggactataggaaacacgcctggggtccacttggactcctctgccagctttcctcctctagatctataattcgctgccccagtgtcacagggaggtcccccctagtccacctgacccccaccctcaacccagccgggacatatctcgggcccctcagtgcccacaccacgtcagagcccggcaggagtgacccagcccattagactatagctgatgtcgcaaagccaggcagctgcgtcaccttccaccctcttttgaacatggccttctaagacaaggacagccagaaccaacaggcagaggctctacaggaggcagacagctgagctggccagtcagggccagccccatgtcccccggaaggagcagatttggaggcagccagaccctgggtcgcactccacggggccacttgggcaagtcagcccctgtgaacctcaagtttctcatctgtacgaaggagctagtgacactgtagctacaactgtgtctagtttgacctacgtgg

SEQ ID NO: 79825 - DNA, 601 bp, Human
aaaaagaacacacacaaacacaacctagacccaaaatcaaaacagaaggcagtgaggaagggagctcacaaatctagaaggtgaggcgcaggggacattccacagcaaccacagcctgtgcaaaggccctgtggtagggagacgctgggagagagcctccctgtgtggctgagtgagccagtcggaagatgagaacacagaagttttccatgaaaaccagaaataaagaaatgtatatgaaatctcctgatttaaaaatgttgcaaaaacatggttttcttaaagggactataggaaacaygcctggggtccacttggactcctctgccagctttcctcctctagatctataattcgctgccccagtgtcacagggaggtcccccctagtccacctgacccccaccctcaacccagccgggacatatctcgggcccctcagtgcccacaccacgtcagagcccggcaggagtgacccagcccattagactagagctgatgtcgcaaagccaggcagctgcgtcaccttccaccctcttttgaacatggccttctaagacaaggacagccagaaccaacaggcagaggctctacaggaggca

SEQ ID NO: 79826 - DNA, 601 bp, Human
gtagaagtggggtttcaccacgttggccaggctggtctcctgacctcaagtgatccgtctgccttggcctcccaaagtgccaggattacaggcatgagccactgtgcctggcctataaaaaataattttttaaaaagtagctgggcatggtgctgcacacctgtagtcccagctacttgggaggctgagatgggagggtcacttgagccaaggaggtcgaggctgcagtgagctgtaatggcgccatttgtactccagcctgggtgtccaagcaacaccctgtctcataaaaaaaaaaaaagaaaagaaagaaagaaaaagaacacacacaaacacaacctagacccaaaatcaaaacagaaggcagtgaggaagggagctcacaaatctagaaggtgaggcgcaggggacattccacagcaaccacagcctgtgcaaaggccctgtggtagggagacgctgggagagagcctccctgtgtggctgagtgagccagtcggaagatgagaacacagaagttttccatgaaaaccagaaataaagaaatgtatatgaaatctcctgatttaaaaatgttgcaaaaacatggttttcttaaagg

SEQ ID NO: 79827 - DNA, 601 bp, Human
ctctgtggcccaggttggactgcagtggcgcgatctcggctcaccgaaaccccatatcccgggttcaagcagttctcctccctcagcctcccgagtagctgggactacaggcacccaccaccatacctggttaatttttgttttagtttttgtttttgttttagtagaagtggggtttcaccacgttggccaggctggtctcctgacctcaagtgatccgtctgccttggcctcccaaagtgccaggattacaggcatgagccactgtgcctggcctataaaaaataattttttaaaaagwagctgggcatggtgctgcacacctgtagtcccagctacttgggaggctgagatgggagggtcacttgagccaaggaggtcgaggctgcagtgagctgtaatggcgccatttgtactccagcctgggtgtccaagcaacaccctgtctcataaaaaaaaaaaaagaaaagaaagaaagaaaaagaacacacacaaacacaacctagacccaaaatcaaaacagaaggcagtgaggaagggagctcacaaatctagaaggtgaggcgcaggggacattccacagcaaccacagcctgtgcaa

SEQ ID NO: 79828 - DNA, 601 bp, Human
gcaagaccctgtctctataaagaataattttatttatttatttattttttgagatggagtctcactctgttgcccaggctggagtgcagtggcatgatcttggctaactgcaacctctgcttctgtgttcaagcgattctcctgccttagcctcctgagtagctgggactacaggcccccaccatcacgcctggctaatttttgtatttttattttattttatttttttgagagggagtcttgctctgtggcccaggttggactgcagtggcgcgatctcggctcaccgaaaccccatatyccgggttcaagcagttctcctccctcagcctcccgagtagctgggactacaggcacccaccaccatacctggttaatttttgttttagtttttgtttttgttttagtagaagtggggtttcaccacgttggccaggctggtctcctgacctcaagtgatccgtctgccttggcctcccaaagtgccaggattacaggcatgagccactgtgcctggcctataaaaaataattttttaaaaagtagctgggcatggtgctgcacacctgtagtcccagctacttgggaggctgagatggga

SEQ ID NO: 79829 - DNA, 601 bp, Human
caacatagcaagaccctgtctctataaagaataattttatttatttatttattttttgagatggagtctcactctgttgcccaggctggagtgcagtggcatgatcttggctaactgcaacctctgcttctgtgttcaagcgattctcctgccttagcctcctgagtagctgggactacaggcccccaccatcacgcctggctaatttttgtatttttattttattttatttttttgagagggagtcttgctctgtggcccaggttggactgcagtggcgcgatctcggctcaccgaaactccatatcccgggttcaagcagttctcctccctcagcctcccgagtagctgggactacaggcacccaccaccatacctggttaatttttgttttagtttttgtttttgttttagtagaagtggggtttcaccacgttggccaggctggtctcctgacctcaagtgatccgtctgccttggcctcccaaagtgccaggattacaggcatgagccactgtgcctggcctataaaaaataattttttaaaaagtagctgggcatggtgctgcacacctgtagtcccagctacttgggaggctga

SEQ ID NO: 79830 - DNA, 601 bp, Human
agagtttgagaccagcctgggcaacatagcaagaccctgtctctataaagaataattttatttatttatttattttttgagatggagtctcactctgttgcccaggctggagtgcagtggcatgatcttggctaactgcaacctctgcttctgtgttcaagcgattctcctgccttagcctcctgagtagctgggactacaggcccccaccatcacgcctggctaatttttgtatttttattttattttatttttttgagagggagtcttgctctgtggcccaggttggactgcagtggcrcgatctcggctcaccgaaaccccatatcccgggttcaagcagttctcctccctcagcctcccgagtagctgggactacaggcacccaccaccatacctggttaatttttgttttagtttttgtttttgttttagtagaagtggggtttcaccacgttggccaggctggtctcctgacctcaagtgatccgtctgccttggcctcccaaagtgccaggattacaggcatgagccactgtgcctggcctataaaaaataattttttaaaaagtagctgggcatggtgctgcacacctgtagt

SEQ ID NO: 79831 - DNA, 601 bp, Human
tccacaaacagctgaccccttcccgtgctgacccacccggtcctctggcccagatagggtctggggggtcggtccctgctcctggtcatgcatgtgtgtgtgtgtgtgtgtgtgtatgtgtgtatgcatgtgtaggtacatgtgtgtgtatgtatgtgtgtgtgtatgtgtatgtacgtgtgtatgtatgtatgtgtgtatgtgtatgtgtatgtgtgtgtatgtatgtgtgtaactcacacatgcaccctccacccagacgcacaccattggtccctccctgctccataaagaacctctytaggcaacgtctggtgattcgcacctgtaatcccagcactttgagaggctgaggcggaggatcgcttgagcccaggacttcaaaaccagcctgggcaacatagcaagatcccatctctaaaaaaaaaaaaaaaaaaaaaaaaaaccctaaaacaaaaacttctctgggactagcacttaccccgactatgacttgcctgcttccggaacaatctctggggctcagtcagcagcctccccatcccgtccactctgagacccctcccctgcccagcctcagccggcccctccaccctcacct

SEQ ID NO: 79832 - DNA, 601 bp, Human
aagtggtatgagtgactgaaggaaatatctagaagtgctttgcagggtggagcacactgaggagctccaaggttgcccggctgagtgactgcacccatcacagacctccagagcaggacccagcacaaggccccagcccagcatcccgggtgtgtctgtcacgtgcccatgtggagccaagaataaccagagccactacaaaggggagcactaaagggactcatgtgcaaaaacggccaggtacagtgcaccggacacagtaagagctcaaaatgatagtctttattttcattattattgktattattaataaatgctcacccaataggatccttaaatgatcattataatggacggagagcatcagaaactgccagttactacccaaagcccaatctctccttactctttcatacaagacccaaaccatactcagagcatcagcacacccagctaaaaggctacctttccagcttcccctggagctaggtgtggccatgtgactcagttctggccaatagaaaggaagtggacattggttttcttcctccctaagagggaggaaactggaacacgctgttttacccccagttcctccatc

SEQ ID NO: 79833 - DNA, 601 bp, Human
ccgagaggaggcttgggagctttctaggaggaatggtcccgggttctgtggctgcagtgttccaccctcccttcctaactccaggagagtctggctttcctcccaggtaaatggcagatcacccccaccacaccctactccagcataaaataaagcatggccaggtcagctccctgagcaatgaaaaaggagaagtggcatgtcacttggggggatgctttaaggactgtgcacacgcctttcaccgggctctctgccgctgctatagcagccaaggaggtatgtgtcaagacagagcctycctcagcctggatccccaagtgaccaccacaagcgcgggtgccccagtcacccacactggacgtggagtgcaagcaaaggaataagtcttggttgttctaagccatggagattccggggctgcttgtcacagcagcaaaacctggcctgtcctaacccatcgaggttcttgatagtggggcccaggctttggtgctccgagagcatttcccagaagctggtttctaatcccaaagacatgcaaagcacaaagtggtatgagtgactgaaggaaatatctagaagtgctttgcagggtgga

SEQ ID NO: 79834 - DNA, 601 bp, Human
gaaggacagggcccccagcatctggttcactgccaaatgcccagtgtctggggaccgagaggaggcttgggagctttctaggaggaatggtcccgggttctgtggctgcagtgttccaccctcccttcctaactccaggagagtctggctttcctcccaggtaaatggcagatcacccccaccacaccctactccagcataaaataaagcatggccaggtcagctccctgagcaatgaaaaaggagaagtggcatgtcacttggggggatgctttaaggactgtgcacacgcctttcaccrggctctctgccgctgctatagcagccaaggaggtatgtgtcaagacagagcctccctcagcctggatccccaagtgaccaccacaagcgcgggtgccccagtcacccacactggacgtggagtgcaagcaaaggaataagtcttggttgttctaagccatggagattccggggctgcttgtcacagcagcaaaacctggcctgtcctaacccatcgaggttcttgatagtggggcccaggctttggtgctccgagagcatttcccagaagctggtttctaatcccaaagacatgcaaagc

SEQ ID NO: 79835 - DNA, 601 bp, Human
atggatgggaagaatatatcccaaactgataactgtgggtttcctctggggcaaggggtaggggtgggaggtgatactaagggcacttatctccctctcttgttttattttgtaatgtgaatctcttctcttttttttggagaccgagtttcactcttctcacccaggctgaagtgaaattgcgtgatctcagctcactgcaaccttcacctcctgtgttcaagcgattctcctgcctcagctcatgagtagctgggattacaggcatgcaacaccacacccagctaattttttgtattttagtagagacagggttttgccatgttggcctggctggtctcgaactcctgacctcaggtgatcccccccacctcggcctcccaaagtgctgggattacaggcatgaactaccacgcccggccttcaaaacatttttgtaagtaaagaatcgaaaggaagaaagcactcagttcccagcagatgccaggtgctcagtaagctcagtaagcaatcactaaccccacctgcccctctgggtggtcaagctttaaccagaggtaaaatccctcctccaacttcaagagtgttcatcctcccagca

SEQ ID NO: 79836 - DNA, 601 bp, Human
tcacgaaggtgaaaaaagccagttgcaaaacaatgcacgtagtatgatttcatgatgttcaaagaagaaacaattccgtatttctctgcgtacacacaggtgtgcacatgggtaaaaatggatgggaagaatatatcccaaactgataactgtgggtttcctctggggcaaggggtaggggtgggaggtgatactaagggcacttatctccctctcttgttttattttgtaatgtgaatctcttctcttttttttggagaccgagtttcactcttctcacccaggctgaagtgaaattgcrtgatctcagctcactgcaaccttcacctcctgtgttcaagcgattctcctgcctcagctcatgagtagctgggattacaggcatgcaacaccacacccagctaattttttgtattttagtagagacagggttttgccatgttggcctggctggtctcgaactcctgacctcaggtgatcccccccacctcggcctcccaaagtgctgggattacaggcatgaactaccacgcccggccttcaaaacatttttgtaagtaaagaatcgaaaggaagaaagcactcagttcccagcagatgc

SEQ ID NO: 79837 - DNA, 601 bp, Human
aatcataatggtggccaccaccgggcaaccccaaaacagaacctgtcaggttaactgactctggggagcgagacccagactcgacaaaaccaactgctcactttccaatcttctgtatgatgaggatgtttaaaatcacgtgcacatgtacagtatattggaatatacaagccacaatgaatgtgaactccatctatcgtgaatggctactgccagttgcagatggtgatttttgccactctgggcaccggttggggtacgatttgtccctagccctcagggtctttgcagtaactaccayggggagtggggagtgggaagtcacacagtcattttcacacatattgagaaaaggtcacgaaggtgaaaaaagccagttgcaaaacaatgcacgtagtatgatttcatgatgttcaaagaagaaacaattccgtatttctctgcgtacacacaggtgtgcacatgggtaaaaatggatgggaagaatatatcccaaactgataactgtgggtttcctctggggcaaggggtaggggtgggaggtgatactaagggcacttatctccctctcttgttttattttgtaatgtgaatctcttct

SEQ ID NO: 79838 - DNA, 601 bp, Human
aaaaaaaaaacctcatcaataacacttgaaatgatcccatttttgatatatgaggtcaaataaaatacattattaaaaataatttcaccaatttcttgttacttgtattaatgcagccactaaaaaattttaaattgcatgtgtgccttgcatattttgatttataggaaagtgccagcttagataacagtattatgtcaatgccaaattttctcattttgataacagcattatggttatgtaagaaaatgtcctcgtttctgaaaaacacccactgagtatttggaggtaagggggcatrcagcctccaacctactctccgatggttctggaaaaagacactcggcgagaagagggggtggggggcttaacacggctagtgaacctgggtgaaggggagacgggggccacttgtatttctcatgcaacttttctttaagtttaaaattcagcttttaaagtcagctgggtacagtagctcacacctgcaatcccagcactttgggaggctgaagcaggaagatcccttgaggctaggagttcaagactagcctgggcaacatagcgagatccccatctctaaaaaattaaataaataaat

SEQ ID NO: 79839 - DNA, 601 bp, Human
tgagtccaaattgggatgcaagtataaaatacattccagatttctaatacttgctagcaaaaaaaacaaaaaaaaaacctcatcaataacacttgaaatgatcccatttttgatatatgaggtcaaataaaatacattattaaaaataatttcaccaatttcttgttacttgtattaatgcagccactaaaaaattttaaattgcatgtgtgccttgcatattttgatttataggaaagtgccagcttagataacagtattatgtcaatgccaaattttctcattttgataacagcattayggttatgtaagaaaatgtcctcgtttctgaaaaacacccactgagtatttggaggtaagggggcatacagcctccaacctactctccgatggttctggaaaaagacactcggcgagaagagggggtggggggcttaacacggctagtgaacctgggtgaaggggagacgggggccacttgtatttctcatgcaacttttctttaagtttaaaattcagcttttaaagtcagctgggtacagtagctcacacctgcaatcccagcactttgggaggctgaagcaggaagatcccttgaggc

SEQ ID NO: 79840 - DNA, 601 bp, Human
tagatggacccgttggcaaacagggttttgggagccacgaagcgataggtggggatgccttcaaacacccctgactccttgtacattagcttcatggatctgcaggggacagacaggatgagaggggacacccagacccggcggccagagccaggccctgccaaaggctgcccagatccagccacttctccccacgggcgctaccacctcccgggtccaaaccgcccccatctctcacccgcggagctgcagcgacctcctaacaggcctctccgctccgactctgcctccccacccacaycaatgtattagccgtggccagatggagttttacaaaagaacagaggccaggcattatggctcacacctgtaatcccagcactttgggaggccgaggtgggaggatcacttgagcccaggagtgtgagaccagcctggggaacatagtgagacccagtctctaaaaataaaattgtttttgaaagttatgaaattaaaaaaagaacagaatatatcatgcccctgctgaaaatctgtgaccctttctagtctaacctaccattaggattcattgaccttatctagcccctgcataagctct

SEQ ID NO: 79841 - DNA, 601 bp, Human
tggatcaccaggaaggacgtgtccgtggcctggacaatgaggcgggggttggggtggggagcaagagagaggaaggagtgaggactcaacctggaggtaaagccatctgggcttgttgacgcactggaagagctgggtgaggacagggaatcaaactgacgcccgagggtccaaactgagcaacttgaggtgggggtgtctcagggactggcacacaattgagacacaccaacaatgtcaggggaccgacgccaacagcagtcatcacatctgcctagccacccacactgcggaacgagargatgttacgtaacacacagaccctcgccagcctcatttcatgtcatttaggacacgtacatgccctaagccccagaacccatgactatgtcaggtcacagggtaaacgggcgctgggcctgctcagcagctgccttgaaggtccagaaattgggccgggcacagtggctcacacctgtaatcccattgctttaacacgcagaggcaggtggatcacttgaggccaggtgtttgagaccagcctgggcaacatggtgaaacaacatctctataaaaactttacaaaaataaaattagctag

SEQ ID NO: 79842 - DNA, 601 bp, Human
gggctactgaaagggctggatcaccaggaaggacgtgtccgtggcctggacaatgaggcgggggttggggtggggagcaagagagaggaaggagtgaggactcaacctggaggtaaagccatctgggcttgttgacgcactggaagagctgggtgaggacagggaatcaaactgacgcccgagggtccaaactgagcaacttgaggtgggggtgtctcagggactggcacacaattgagacacaccaacaatgtcaggggaccgacgccaacagcagtcatcacatctgcctagccacccmcactgcggaacgagaagatgttacgtaacacacagaccctcgccagcctcatttcatgtcatttaggacacgtacatgccctaagccccagaacccatgactatgtcaggtcacagggtaaacgggcgctgggcctgctcagcagctgccttgaaggtccagaaattgggccgggcacagtggctcacacctgtaatcccattgctttaacacgcagaggcaggtggatcacttgaggccaggtgtttgagaccagcctgggcaacatggtgaaacaacatctctataaaaactttacaa

SEQ ID NO: 79843 - DNA, 601 bp, Human
cttcctctgttgcccaggctggagtgcagtggggtgatcacagctcactgcagccttgacctctgggcttaggccatccttccaccccagctttccacgtagctaggactacaggcatgcaccaccatgcctagctaattttttttttttttttttttttgccagagagaggtcttgctatattgcccaggctggtctcgaactcttggcctgaagtgatcctcccacctcggcctcctacagggttgtgattacaggcgtgaaccaccacactcggcctgcattgttaaaagatccctcsgctgctgtcgggagtgctacagaacttcctatgatgatggaaatgttctctatctgtgctatccaagacagtagctgctagacacacatggcttatgagcatttaacttccggccggtgcaaccaaggaactgccttttaatttgatttcgtttaaatcaatttcaatttaaacagccgcaagaggccagcagtgaccgcactggatggtctaggggatggatggtaaggcggcaacactgcattgagggatgggctactgaaagggctggatcaccaggaaggacgtgtccgtggcctg

SEQ ID NO: 79844 - DNA, 601 bp, Human
agacaagaagacaagaagaggaagccatagggagcagcaggtgggagagggggcaactttagaacaggaaatcagaggaggcctcccggaggaggtggcatttgcatgcaggccaaaagaaggtgagggatgatccactcagaaatccagacaaagagctctccaagcaggggaagcaacccatgcaaaccacagtgcaaggcactgaccttggtatactttagaaaaagggcgaaggcatcagggctggagaataatgaacaggggacgtgtagggagaaatggagtcagagaggctggyggggctggatccttcagagaggccggtaggggctggatcctgcagggcccagggccatggtgggagtttggacttcactatgaatgcagacagagctgccagacattttaagaggacggcggccatctgcatatttttcgagatgggtcttcctctgttgcccaggctggagtgcagtggggtgatcacagctcactgcagccttgacctctgggcttaggccatccttccaccccagctttccacgtagctaggactacaggcatgcaccaccatgcctagctaatttttttttttttt

SEQ ID NO: 79845 - DNA, 601 bp, Human
tgtgcctaatgcagagatctgccctggaatttttcattacgcaaaccaagaagtgcccttttggcctaaatcaggtggagtccagcatctgccacttgcgacagttgctgtagcacacctattgggtgtgtaacatcctcaaccttaggagcagaaatccccgccgataccagcaaagaatgaagcaagcagaggccaatgcccagacgggccagacaggaccaggagacagcagcgggcgtcccaggccccagctccaaaccattcattcacaggttgttccattctgcctgaaataggrgaaagcatccaatctgttgacagcccctcctcctgacccctgttgcagaccagtcctttagagtcgccattgccagctggaggacggggcttcaaccaaaaaggctcccagaaggcaagacacagtcaaatagagggccgcttccggtcctaccaaccctgtgaccttggtcgcatccagcatcaggcctcaatttcctaagtacagaacgcactcaccatccctatattcaaatactgtatgagtacccattacatgcggggcacagttctagaagctaagaataaaaccaacaagagg

SEQ ID NO: 79846 - DNA, 601 bp, Human
gtcaaggctgctgtgagctgtgattgcaccactgcacttgagcctgggcaacagagaaaccctgtctcaaaaatataaataaatataagaaaaaactctatttaaataaagattttaaaattcctttgcgcttttgaaattcttttggcagatgtgctaagagaaggcgggacacacctcgtcccacgcccttggaggggatgggcatgtcgtttctcccccttctcctggtacctacacccctactttaagccttccctactttcagccttgtgcttggagtggggccggcccacccagsagccatctgagcatgtgacacaagcctggccaatcagcatagtccacctcggctactgtgattggtttacagctgggcatgggagccaggcagaccaattagagcaaaccctggaacttctgctggagtgaaggaaacacaggtggccccctttctgcaggactcggagctgggcggaggtgagcctggagcctccacaggcagccaggagggagagcctgcttggcagcaaagccagtccagcagaaaactgagctgggacttggcagaggcagcttccagacaacatctaagttctgg

SEQ ID NO: 79847 - DNA, 601 bp, Human
acctgtgctcccagctacctgggaggctgaggtgggagaatcatttgtgcccaggaggtcaaggctgctgtgagctgtgattgcaccactgcacttgagcctgggcaacagagaaaccctgtctcaaaaatataaataaatataagaaaaaactctatttaaataaagattttaaaattcctttgcgcttttgaaattcttttggcagatgtgctaagagaaggcgggacacacctcgtcccacgcccttggaggggatgggcatgtcgtttctcccccttctcctggtacctacaccccyactttaagccttccctactttcagccttgtgcttggagtggggccggcccacccaggagccatctgagcatgtgacacaagcctggccaatcagcatagtccacctcggctactgtgattggtttacagctgggcatgggagccaggcagaccaattagagcaaaccctggaacttctgctggagtgaaggaaacacaggtggccccctttctgcaggactcggagctgggcggaggtgagcctggagcctccacaggcagccaggagggagagcctgcttggcagcaaagccagtccag

SEQ ID NO: 79848 - DNA, 601 bp, Human
gcgttgactttgtgaagtttcaaactgcaggtgtcagccaggcgcagcggttcatgcctgtaatcccagcactttgggcgggaggatcacttgagcccaggacttcaagactagcctgggcaatatggtgagaccccgtctcttaaaaaaaatttaagaattagctgggcatggtagcaaccgcttgtagtcccagctactcaggaggctggggtaagaggatcaattgagtgatggaggtcagactgctgtgagccatgatggcaccactgcactccagcctgggcgacagtgatacccygtctcaaaaaacaaagcaaaaaaccccaaaaactgcatgagtcatctgggaacttctttgtatctatgtatattttatttagaagcaaaaactaagcccgggcaagacggcacaaccccacctctacaaaaaaaaaaaaaaaaaaaaaaattgaaataagataaaataaattagccaggtatggtggtgtgtacctgtgctcccagctacctgggaggctgaggtgggagaatcatttgtgcccaggaggtcaaggctgctgtgagctgtgattgcaccactgcacttgagcctgggcaa

SEQ ID NO: 79849 - DNA, 601 bp, Human
agggaggtttgagatgagggagttgtctgagtccaacagatttcaaggcccagaaaggcaaaggcatggtacctttactctttagataacatgccacagaaacacagacataggtgcaccaaacgacacgtgtgcaccacggtcacggtcgaaaaacaggaacttggatgcctaggagcaatggaaggagaagatggaggtggcacccacgatggaacaccacacagcaacggagaggaggggctgctaccacccacaacgtcacggacgaattgcaccagggtgctaaggggtgcacggrccagaaaaggaggaaaaggagtctagcattatgggtccattcacatgaagatgcaaaccagctgagctccggggctggatgtcagggcggtgggaggaccgcgagtggcatccagggcctgtcctgtctgtttctcagtcagggtgctggccacggggtgcgttgactttgtgaagtttcaaactgcaggtgtcagccaggcgcagcggttcatgcctgtaatcccagcactttgggcgggaggatcacttgagcccaggacttcaagactagcctgggcaatatggtgagaccccgtct

SEQ ID NO: 79850 - DNA, 601 bp, Human
gttaaaagaaaaaacaaaacaaaaaaggctgatgagtgtggaaggctcttcaagtcctctcaacaccaagagaccttctcctgcaggtgatggcaaggaggaaaagagcatggacccagaagctcactctcacctccttggaccttctgaagccatcccaagcacccgcagggacagtgtcctccacaatctggaaaacgctgcctctcgtgcctcctccgtggaggaggcagccacggagccgaactctggaggaatctcaaacaagccctggcctgcccacagccccaggtggagaccraggtgggatggaacaacttgccagcccccgcccttgcttcagaggccgagcctgcatggacccacgcacgtgtttcttccaatgttattaccaagcacgccgagagagatcttcccagctgtaagtggtaattaatttgtagctttatggcatatctagccagacataattgcccaggattgccaccgatgataattagttggctctgtgaggcaagtcggatgccctcacgcaacagggaggtttgagatgagggagttgtctgagtccaacagatttcaaggcccagaaaggcaaagg

SEQ ID NO: 79851 - DNA, 601 bp, Human
agaatcgcttgaacccaagaggcagaagttgtggtgagccaagattgcaccattgcactccagccttggcaacagagcaagactgtgtctcaaaaaaaaaaaaaaaagacatagttaaaaaataccgtggaaaataatgatgttgtaagttctaactagaacctgttactgcatgaggctttaactgggagccctgctctttttctgttaaaagaaaaaacaaaacaaaaaaggctgatgagtgtggaaggctcttcaagtcctctcaacaccaagagaccttctcctgcaggtgatggcraggaggaaaagagcatggacccagaagctcactctcacctccttggaccttctgaagccatcccaagcacccgcagggacagtgtcctccacaatctggaaaacgctgcctctcgtgcctcctccgtggaggaggcagccacggagccgaactctggaggaatctcaaacaagccctggcctgcccacagccccaggtggagaccaaggtgggatggaacaacttgccagcccccgcccttgcttcagaggccgagcctgcatggacccacgcacgtgtttcttccaatgttattaccaa

SEQ ID NO: 79852 - DNA, 601 bp, Human
gtctgcagggcacccccgtggcgatgacaagataaccagacagagaggatcccttcctccattctgtaaaaagccccaggccctgtgatgagggacaagctctgcgccagagaaggggtgaggcaggagccgctgattctgacaggagagaccaaaagaaggaagaggcctcttcacaggagccaggtgaaggatgcccgggaagcgcattccaggtggaagggaaggcagaagcaagcgtggggagggggaaatgcatggtgcacaagggtgctagggaggcacggatggaaaaggcaaygccagatttgaacttgggtgtggggaggggagtctcaagcgcaagccaagcagcccacactgtcccctgcaggacacgcagcaatgatcggagctcaggtgtgtgcacctgtggccagatctccctgcatccacaggagtgtgtccctgtagacacacctgctacaaatgtgagctcaacctcgccactgaccaaccaaaccaggcaaacaccagctcaccctcgggacaatggacaacaggcctgaaggacaagttaacaaggaacagcgagcgggcctctctcaaaagctcacgaggg

SEQ ID NO: 79853 - DNA, 601 bp, Human
caatgtattgtaagcttgaaagttgctgacagtagattttaaatgttctcagcaccaatacatcatcagtatgtgaggtaatgcatatgttaattggcttgatttaggtattccacaagttatatacatacatcataacatcatgttgtacactcaaaaatagacagcttttctttttcaatttagagaattaattttggctgggcacggcggttcatgcctgtaatcccggtactttgggaggccaagacaggaggatcgcttgagcccaagagttcgagaccagactgggcaacatggyaaaaccgcgtctctacaaaaaatataaaaattagccaggcatggtggtacatgtctgtagtcctggctacttagggaggctgaggtgggaggatcacctgaacccagggaggtcgaagctgcagtgagccatgatcatgccactgcaccccagcctgggcaaccgagtgagaccctgtctcaaaaataataataattttgttaaaggcccatgggatagaccacaagtgcccacccaggaaacagaaaaccacagatttctgaatcaatggtagcagccaccaagaccaactgggcatat

SEQ ID NO: 79854 - DNA, 601 bp, Human
agcagaaaagtggccacacggaagcagcttccaacacacgttcgtttttcaaggctaaaggccaacaggcagcaagctgatctcctgatccccctccccaacgtgcccagctcaaaaaacaaagaaataaaggccacttcctctccccgtcggcctcaagctcatctggaggtagaattggacgcagcagctaaagtggctgcggcaaaacagctgtttgcctctctctgggctcccaaacttaaccccttctttcttgatgtgaggggaagaaagaaaatccgtgccctgaaaggaaagygatcactgagagcgcacaggagactgtgttcatggtggaattctccggaagccagcagagcaagagaggctggaggaggaattaactaaaagagggaaggcagagaccagggctggggccggggccgagagggcctagtcagcggctaaggaggcctgggaggacaaagaaaaatggtgcagaacagcatccgccatggagcttcgggaagggcctaaggtgcacagcattgtggcaaacgtgtggagcttcctcagacaacgaaaaccagaactaccatcggatcagtgatcccactgc

SEQ ID NO: 79855 - DNA, 601 bp, Human
tttttccctttgctaattttgctttgaattctgtcattacaataagtcttagctgtgataccaccataagcagcgtcctgttgagtcccccgtccccatgccctcccccagtttcaggagcagaaaagtggccacacggaagcagcttccaacacacgttcgtttttcaaggctaaaggccaacaggcagcaagctgatctcctgatccccctccccaacgtgcccagctcaaaaaacaaagaaataaaggccacttcctctccccgtcggcctcaagctcatctggaggtagaattggaygcagcagctaaagtggctgcggcaaaacagctgtttgcctctctctgggctcccaaacttaaccccttctttcttgatgtgaggggaagaaagaaaatccgtgccctgaaaggaaagcgatcactgagagcgcacaggagactgtgttcatggtggaattctccggaagccagcagagcaagagaggctggaggaggaattaactaaaagagggaaggcagagaccagggctggggccggggccgagagggcctagtcagcggctaaggaggcctgggaggacaaagaaaaatggtgcag

SEQ ID NO: 79856 - DNA, 601 bp, Human
agctactcaggaggctgagtcaggagaatcgcttgaacctgggaggcggaggttgtggtgagccaatatcccgcccttgcactccagcctgggcaacaagagcgagactccatctcaaaaacaaaacaaaacaaaacaaaaaagagaaagaaaagtggtgttctggggaaggaatatcaggatgcaggtcaggacctggctcaaaaccaagacccctcagggagaagatcagcagggactggattccacccccaataggaccctctcccctccccatgccctggttcctggggtatgtcaytggagtctgggaccactggagcactgagcacctaatctctcaatgagcaatgcagccccagctcccagtccccactcacccaatgcctgcgacagatttcatgtagaggctcagctgcagtttcacagagcagttcatggggattcccgtgacctgcggcaacaaacacagtgaggagactggccacccccaagctccagggacaccgtcaaccctcctctccctggtcccagtcaagagggtgggcgtcccagctaactgcccagtggagcttgcttgtatcttacctaaaacaagcca

SEQ ID NO: 79857 - DNA, 601 bp, Human
atcccagcactctgggaggcggatcacctgaggtcacaagttcgagaacagcctggccaacatggtgaaatcctgtctccactaaaaatacaaaaattagctgggtgtactggcgagcgcctgtaatcccagctacttgagaggctgaggcaggagaatcgctggaacccgggaggcagaggttgcagtgagctgagatcatgccactgcactctggcctgggtgacacggcaagacttcgtctcaaaaaaaaaaaaaaaaaaaaaaaaagaatgtgaattacctcccaataagtaaaaaytgacagagctcctgttaaaattcagatttggaagtccttttgaaaaatgcagaggatgtggccacactgagcccgcatttccatggggctacagtcagctggtgctgggaaggggctgtatcctcggccccaggtcgcctcttctatctgggtcacccacttggccccagttgcatcccagttagcagcccaggtgccacgcggtggaaccagagggaggacttgggctgcaaacgcctcttccatgcctggggctgtttccccacccacaaatccatcaagaacaaattccctaagtgg

SEQ ID NO: 79858 - DNA, 601 bp, Human
cctccacatctgctgttgagaccactttcctggagtgccttgttcccagtccacagggaggtcagcagctgtgcggcccagagaggttgggtgaccggtccacaggtcactggcaggcacaatccagctgcccgcgtgaactgtttgttaagaatgtgaattaggcccagcgcagggctcatgcctataatcccagcactctgggaggcggatcacctgaggtcacaagttcgagaacagcctggccaacatggtgaaatcctgtctccactaaaaatacaaaaattagctgggtgtactrgcgagcgcctgtaatcccagctacttgagaggctgaggcaggagaatcgctggaacccgggaggcagaggttgcagtgagctgagatcatgccactgcactctggcctgggtgacacggcaagacttcgtctcaaaaaaaaaaaaaaaaaaaaaaaaagaatgtgaattacctcccaataagtaaaaattgacagagctcctgttaaaattcagatttggaagtccttttgaaaaatgcagaggatgtggccacactgagcccgcatttccatggggctacagtcagctggtgctgggaa

SEQ ID NO: 79859 - DNA, 601 bp, Human
ctcactgtgcctgagcaatctgtacaagtaatgtggtttatactgaccaccagcttgccttctaagggtctggaatttcagtacctgccaggcagagggtggccacatgaccagcccctagtaaaaaccctgggcactcagtctctctagcgggcttccctgccagatgacatgtcacgtgggttgtcacaactccttgcagcaagaattgggtgactcccctgggagagggctctggaaactggcacctgctttcctctggacttggccccgtgtggcttttccctttgctgatttgctytgaatccttttaccgtaataaatcatagccacgtgtacaaccatatgcttcgtcctgaggcttcccagcaaatcgtcgagcctgcggtggccttgggacccctgacacagccacttacgagctctgtgaccttgggcgtgctactgagcctgtgtcccttctgtataagcgagatattataacgtaactcttcctaggactctagggaggattcaatgcagtaatacatgtaaagtgcttcgaaaattacccggcatataaaagtgcttggcacatttattattgttgttgttataattg

SEQ ID NO: 79860 - DNA, 601 bp, Human
ggcaggcccgagcccttccaccccacacaggctgctggcaatgctggcccggagctggcgtctgggagcctggattcgggaggcctcccattgctccctaactgacaaggatggctcactgtgcctgagcaatctgtacaagtaatgtggtttatactgaccaccagcttgccttctaagggtctggaatttcagtacctgccaggcagagggtggccacatgaccagcccctagtaaaaaccctgggcactcagtctctctagcgggcttccctgccagatgacatgtcacgtgggttgycacaactccttgcagcaagaattgggtgactcccctgggagagggctctggaaactggcacctgctttcctctggacttggccccgtgtggcttttccctttgctgatttgctttgaatccttttaccgtaataaatcatagccacgtgtacaaccatatgcttcgtcctgaggcttcccagcaaatcgtcgagcctgcggtggccttgggacccctgacacagccacttacgagctctgtgaccttgggcgtgctactgagcctgtgtcccttctgtataagcgagatattataacgta

SEQ ID NO: 79861 - DNA, 601 bp, Human
ctggggcgtggtggctcacgcctgtaatcccagcactttgggaggccgaggcaggtggatcacaaggtcaggagattgagaccatcctgggcaacatggtgaaaccccatctctactaaaaatataaaaattggccggacgtggtggcacatgcctgtaatcccagctactcgggaggctgaggcaggagaatcacttgaaccagggagtcagaggttgcagtgagcggagatcatgccattgcactccagcctggcgacagagtgagactccgtctcaaaaaaaaaaaaaaaaaaaaaaagagggaagcaggaggttagaggcagagagaaattggacagtgctacactgctggctttaaagagggagaggccaagtgcagtggttcacgcctgtaatcccagcactttgggaggctgaggtgggaggatcacttgcaccctggagttcaagaccagcctgggcaacatagtgagacccctgtctctacaaaaaaaacacaaaaattagcagggtatggtggcacatgcctgtagtcccagctactcaggaggctcaggtgggaggatcgcctaagcccaggaggccaaggctgcagtga

SEQ ID NO: 79862 - DNA, 601 bp, Human
aaggttctgagatgggaagagtatcctggaatacctaggtaggccccagagaatcacaaaagtccttaaagagagaagcgggaagtcctagccagagcaatcaggcaagagaaagaaaaacgaaaaaacaaaaacaaattttaaaaccctaaaaaaagaaaaattaatttttaaaaagaggggctggggcgtggtggctcacgcctgtaatcccagcactttgggaggccgaggcaggtggatcacaaggtcaggagattgagaccatcctgggcaacatggtgaaaccccatctctactraaaatataaaaattggccggacgtggtggcacatgcctgtaatcccagctactcgggaggctgaggcaggagaatcacttgaaccagggagtcagaggttgcagtgagcggagatcatgccattgcactccagcctggcgacagagtgagactccgtctcaaaaaaaaaaaaaaaaaaaaaaagagggaagcaggaggttagaggcagagagaaattggacagtgctacactgctggctttaaagagggagaggccaagtgcagtggttcacgcctgtaatcccagcactttgggaggct

SEQ ID NO: 79863 - DNA, 601 bp, Human
tgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgatactgcagaaacgtcacaggcatgacctcatccaggctatcaaggtcgacatcaacagtgatacagtatgttgacggaatgtacccaagatgctctgaaaytggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaatgcgacacctgggaaactgtgacctgccacgacgaaggggaccgtgcagacatgactgcatcaaggctctcagatggggagagcgtcctggaatatctag

SEQ ID NO: 79864 - DNA, 601 bp, Human
ggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgatactgcagaaacgtcacaggcatgacctcatccaggctatcaaggtcgacatcaacagtgatacagtatgttgacggaatgtacccargatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaatgcgacacctgggaaactgtgacctgccacgacgaaggggaccgtgcagacatgactgcatcaaggctctcagatggggagagcgtc

SEQ ID NO: 79865 - DNA, 601 bp, Human
tatcttctctatggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgatactgcagaaacgtcacaggcatgacctcatccaggctatcaaggtcgacatcaacagtgatacagtatgttgacrgaatgtacccaagatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaatgcgacacctgggaaactgtgacctgccacgacgaaggggaccgtgcagacatgactgcatcaaggctctcagat

SEQ ID NO: 79866 - DNA, 601 bp, Human
acacatgcacacagaggcacaaagatgttcagtgttgcttggactagcaaagacaaacagacaaacgacaatatgtatcttctctatggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgayactgcagaaacgtcacaggcatgacctcatccaggctatcaaggtcgacatcaacagtgatacagtatgttgacggaatgtacccaagatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaa

SEQ ID NO: 79867 - DNA, 601 bp, Human
agatgctcacacatgcacacagaggcacaaagatgttcagtgttgcttggactagcaaagacaaacagacaaacgacaatatgtatcttctctatggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtwaacttgatactgcagaaacgtcacaggcatgacctcatccaggctatcaaggtcgacatcaacagtgatacagtatgttgacggaatgtacccaagatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccgg

SEQ ID NO: 79868 - DNA, 601 bp, Human
atgttcacataacttttattatagtatttgttataattaccctattcttagttattgttaattgtggctatgcctaatttataaattaactttatcatagatgtgtgtgtataggaagaagcatagtatatgctatacagggttcagtactatccccagcttcaggcatccactgggggtcttggaatatacccccagggataaggggtccatggtacttgattggcatgggctgagggaaccagtgtttcgatgtgctgccagaaggaatctcccctggcaaagagcttgacaacttgawaataatctttttaaactaaaaactcacatctcctacagggcagagaccaccagtgacccagccaaaatccattggtcccttttagaaacaggacccaaattttactcaggatggcaatgcacccagttaaagactccacttcagcctctcttgtggcaagtgaggctctgtgaccaagttctggttaatgagatgttcgcagaagcgttacgtgggatggccgggagggctgcttaaaaagaagctttcacagctgggaggtgaaccttttttccctcctccctttcagatgcctgaaac

SEQ ID NO: 79869 - DNA, 601 bp, Human
cggcaggaccacaggctcaatcttcccagtttgtctggaaataagcaagacatagctgtgtgaaacaaagtcttacacccaaacttgatctaattctgcttgaatacaacatctaaacaggtttagtataattttgcacacactaaaccctcaccaccaaatataaacaatgagctgaaacactttaggagccatatgacaaaactgtccccaggctgaaggtctcagtctacagccctcaataatacttgtaaataagactaactttaaatctttaaaaggcgttttgtttttttttttmtttagttgacaaggtgagatgttttcccacagggctgtttgacatcacacagctttgaacctgtgatcataagctctgaggccaggagggatttgattctgcaatctcagtcatccctccttatccatggttttgatttctgccatttcttaccctcagtacagtacaataagatattttgagggagagaccatgttcacataacttttattatagtatttgttataattaccctattcttagttattgttaattgtggctatgcctaatttataaattaactttatcatagatgtgtgt

SEQ ID NO: 79870 - DNA, 601 bp, Human
gcggcaggaccacaggctcaatcttcccagtttgtctggaaataagcaagacatagctgtgtgaaacaaagtcttacacccaaacttgatctaattctgcttgaatacaacatctaaacaggtttagtataattttgcacacactaaaccctcaccaccaaatataaacaatgagctgaaacactttaggagccatatgacaaaactgtccccaggctgaaggtctcagtctacagccctcaataatacttgtaaataagactaactttaaatctttaaaaggcgttttgttttttttttwctttagttgacaaggtgagatgttttcccacagggctgtttgacatcacacagctttgaacctgtgatcataagctctgaggccaggagggatttgattctgcaatctcagtcatccctccttatccatggttttgatttctgccatttcttaccctcagtacagtacaataagatattttgagggagagaccatgttcacataacttttattatagtatttgttataattaccctattcttagttattgttaattgtggctatgcctaatttataaattaactttatcatagatgtgtg

SEQ ID NO: 79871 - DNA, 601 bp, Human
agcggcaggaccacaggctcaatcttcccagtttgtctggaaataagcaagacatagctgtgtgaaacaaagtcttacacccaaacttgatctaattctgcttgaatacaacatctaaacaggtttagtataattttgcacacactaaaccctcaccaccaaatataaacaatgagctgaaacactttaggagccatatgacaaaactgtccccaggctgaaggtctcagtctacagccctcaataatacttgtaaataagactaactttaaatctttaaaaggcgttttgtttttttttttctttagttgacaaggtgagatgttttcccacagggctgtttgacatcacacagctttgaacctgtgatcataagctctgaggccaggagggatttgattctgcaatctcagtcatccctccttatccatggttttgatttctgccatttcttaccctcagtacagtacaataagatattttgagggagagaccatgttcacataacttttattatagtatttgttataattaccctattcttagttattgttaattgtggctatgcctaatttataaattaactttatcatagatgtgt

SEQ ID NO: 79872 - DNA, 601 bp, Human
gctccaggctgcggttggccagagggtccgatctgaggcccctttcccccagcaggcaagcgaatggctgtcagcccgggctgccctctggccagcacctacttggctccggatttggcagatgacagggaccagcagcaggacgcagcccagcgccaggaggacgtactgggcatagtgcatcaccttgggcatcaacaccagctgagtgtagaatgtgtgaagagtctccccctccatggccccgctctgaggagacagaatgacaaacacatgagctggggccgcacgctgcgggctmcagcgcagatgccacccaacaccttcctctgtgcccgcctcagcttttccccacctcaagcttcccggctaaagcatgtgttggagcctgccagggacctcctccctccaggacacaaggtgagactacaattccccgactcccttgcagttgggcagggccatatgatcgtgtcctgaccaatgggaggtggacctggcctcacgtgactctccatctcgttccctgccactgaatggaggctctccaggatggcggggccaccggggccctggaaccctaaatgactgcagggagcag

SEQ ID NO: 79873 - DNA, 601 bp, Human
gctggaggtgggctccaggctgcggttggccagagggtccgatctgaggcccctttcccccagcaggcaagcgaatggctgtcagcccgggctgccctctggccagcacctacttggctccggatttggcagatgacagggaccagcagcaggacgcagcccagcgccaggaggacgtactgggcatagtgcatcaccttgggcatcaacaccagctgagtgtagaatgtgtgaagagtctccccctccatggccccgctctgaggagacagaatgacaaacacatgagctggggccgcasgctgcgggctacagcgcagatgccacccaacaccttcctctgtgcccgcctcagcttttccccacctcaagcttcccggctaaagcatgtgttggagcctgccagggacctcctccctccaggacacaaggtgagactacaattccccgactcccttgcagttgggcagggccatatgatcgtgtcctgaccaatgggaggtggacctggcctcacgtgactctccatctcgttccctgccactgaatggaggctctccaggatggcggggccaccggggccctggaaccctaaatgact

SEQ ID NO: 79874 - DNA, 601 bp, Human
cttggttttcatctgtctccccggctgggatgccagcccccctcaatccccctgagcagggatctcagctgtctcctctactgctgtacgtcccctcgcccctaacagaacctggcatccccgggtgctgacttgatgaatggatgatgcaagtaccaggtctcattactcaaagcccacctgtgccccctccaagggagggtcccaggccttccagaacaggcagagtagtggcaacgcggcatgcaaaagacgcaagcgtgctgcgcagcccccagcagtgaccgctcccactccggcrgagacgcaggactgctgctggaggtgggctccaggctgcggttggccagagggtccgatctgaggcccctttcccccagcaggcaagcgaatggctgtcagcccgggctgccctctggccagcacctacttggctccggatttggcagatgacagggaccagcagcaggacgcagcccagcgccaggaggacgtactgggcatagtgcatcaccttgggcatcaacaccagctgagtgtagaatgtgtgaagagtctccccctccatggccccgctctgaggagacagaatgacaaacac

SEQ ID NO: 79875 - DNA, 601 bp, Human
tgacctgtgcaaagggccttgcagtgaatgcatgaatgaataaataaatgaccccgaagcaaggagggacactgttatcacccctcttcctgctgcttctggaggtctgaagcccagggctggagctcttccccacttccgttccctcctgatagcagctgccccatcctgttcaagccatcgacttcctcacgcactggggcctccccgctgggcccaggcttccacccctcccagcccggggcccattccccagccagcagctgacctagtgattcccctctttaaaagcctccaatgsctctgtcactcccagaatcagttccaaactgctcactgtgcaccacgaggccctgggtggcccgccctgtccactctcagacaccacctcctacctctgtccctgccctcactcccctccagccaccctggccctacctgaccgtccaatgtgccttgcctgtccctgccacagggcctttgcagtggccgctccaggcagcattcctcatgtggctgtgtgctgagtgcctccctggcctccatgtcaaagctcactatctacctcttcagagaggccttcctgaagctccatctgtcc

SEQ ID NO: 79876 - DNA, 601 bp, Human
gagcagcggggcagccccaaggcccctcagaaggcctcggcctgtggccctaggatgatgcaggtgggggccacctcagagagtggctttctggtccatgcatccaaaaacagcctttcctgatgacctgccagtgggcagcatcccttcccctgccatggcagccactcgcccatctccactgccccttgagctctgtgatcacagctctcctgtccttcgtgtgactgtagtaacttgcctaaaggcctgccttgcccatctttgctgcagatctcatgttctggtcatttctgcatcycctgacctgtgcaaagggccttgcagtgaatgcatgaatgaataaataaatgaccccgaagcaaggagggacactgttatcacccctcttcctgctgcttctggaggtctgaagcccagggctggagctcttccccacttccgttccctcctgatagcagctgccccatcctgttcaagccatcgacttcctcacgcactggggcctccccgctgggcccaggcttccacccctcccagcccggggcccattccccagccagcagctgacctagtgattcccctctttaaaagcctccaa

SEQ ID NO: 79877 - DNA, 601 bp, Human
ctgcagaggagccaagaccagcagagcagcggggcagccccaaggcccctcagaaggcctcggcctgtggccctaggatgatgcaggtgggggccacctcagagagtggctttctggtccatgcatccaaaaacagcctttcctgatgacctgccagtgggcagcatcccttcccctgccatggcagccactcgcccatctccactgccccttgagctctgtgatcacagctctcctgtccttcgtgtgactgtagtaacttgcctaaaggcctgccttgcccatctttgctgcagatctyatgttctggtcatttctgcatctcctgacctgtgcaaagggccttgcagtgaatgcatgaatgaataaataaatgaccccgaagcaaggagggacactgttatcacccctcttcctgctgcttctggaggtctgaagcccagggctggagctcttccccacttccgttccctcctgatagcagctgccccatcctgttcaagccatcgacttcctcacgcactggggcctccccgctgggcccaggcttccacccctcccagcccggggcccattccccagccagcagctgacctagtga

SEQ ID NO: 79878 - DNA, 601 bp, Human
tttgaaaggaagtcgggtttcaggtctgaaagccaaggtgaagaaccaggaatgctttattgtcacccagcatgcaagcatggaagcaggcaagccttccctgagacaggggaagaggaagaatcattcaccagtgctaaaggaagcaggtgctgcagaggagccaagaccagcagagcagcggggcagccccaaggcccctcagaaggcctcggcctgtggccctaggatgatgcaggtgggggccacctcagagagtggctttctggtccatgcatccaaaaacagcctttcctgatgmcctgccagtgggcagcatcccttcccctgccatggcagccactcgcccatctccactgccccttgagctctgtgatcacagctctcctgtccttcgtgtgactgtagtaacttgcctaaaggcctgccttgcccatctttgctgcagatctcatgttctggtcatttctgcatctcctgacctgtgcaaagggccttgcagtgaatgcatgaatgaataaataaatgaccccgaagcaaggagggacactgttatcacccctcttcctgctgcttctggaggtctgaagcccagggctgg

SEQ ID NO: 79879 - DNA, 601 bp, Human
tttcgtttgtttgtttgtgctcaatctggcaatcctaccctcagatccagtcccaggtatacagttggtgttcagttgatgcctacattctttgttcttggtcagtcatcccagatgtatttatttatttatttattttagttttatttttttgagacggagtctcactctgtcacccaggctggagtgcagtggcacgatcttggctcactgcaacctccatctcccgggttcaagcgattctcctgcctcagcctcctgagtagctgggattacaagcgtgtgccaccacacccagctmattttttttgtatttttagtagagacaggttttcaccatgttggccaggctggtcttgaactcctgacctcaaatgatccacctgcttcggcctcccaaagtgctggattacaggtgtgagccaccgcacctggccagtcatcccagatttagatcaatgcctctcaaacatgtttctacatcagaatctcattagggtccattaaaatacagattccagggtcccaccatgatcctattccagaaggctagaaggctgcccagggatctgcatttctagcagacttccccaggggagtc

SEQ ID NO: 79880 - DNA, 601 bp, Human
ctatgttcccagcagatagggcggccacataaaatcagaacgcctagttaaatgtgaatttcaggtgaactacagacaggttttcaggatacgtgcgtcctatcattgcacaggaacacaataaaaattacttattgcttaccagaaattcatatttaacaggcacccttctgttgtttcttgtgtttcgtttgtttgtttgtgctcaatctggcaatcctaccctcagatccagtcccaggtatacagttggtgttcagttgatgcctacattctttgttcttggtcagtcatcccagaygtatttatttatttatttattttagttttatttttttgagacggagtctcactctgtcacccaggctggagtgcagtggcacgatcttggctcactgcaacctccatctcccgggttcaagcgattctcctgcctcagcctcctgagtagctgggattacaagcgtgtgccaccacacccagctcattttttttgtatttttagtagagacaggttttcaccatgttggccaggctggtcttgaactcctgacctcaaatgatccacctgcttcggcctcccaaagtgctggattacagg

SEQ ID NO: 79881 - DNA, 601 bp, Human
tggctgctcagggtatgcggggcgcgggacgtggggagggggacgagggccacccagggaacgagtgaaaccaagggcatgagatgctggccatcttcaacactgacagctgtcagcaatggctgcgtctgggtgaggggaactggatactgtcatttgtctagtttgacagttgtagaaaatttctcaacttaaaaattaaaaatacagataatgctaatgataagagtgtggggtgagccttcgtcccactaagccccctgcctcccttgccctgagcaacagaggcctccctgccccrgtggctggggctggaaaccgctgcccacctccgcccacctgtgcttgcttcaccacggggtaggaaaatcaaactcctgctcagggcagagagcgggcacaggggccagggtctgctgcactgagccaggcgcgggggaggtcagccccgcccccacaccacccactgaggcagcacaggacacccacaggtggctagaccttagccatgtgggcccaaagagccgtgacttgagaaggtctcactcagaagtagaaaggggaaaccacccctaggctgtaaaagaaccccttgtctttc

SEQ ID NO: 79882 - DNA, 601 bp, Human
tggccatggctgctcagggtatgcggggcgcgggacgtggggagggggacgagggccacccagggaacgagtgaaaccaagggcatgagatgctggccatcttcaacactgacagctgtcagcaatggctgcgtctgggtgaggggaactggatactgtcatttgtctagtttgacagttgtagaaaatttctcaacttaaaaattaaaaatacagataatgctaatgataagagtgtggggtgagccttcgtcccactaagccccctgcctcccttgccctgagcaacagaggcctccckgccccggtggctggggctggaaaccgctgcccacctccgcccacctgtgcttgcttcaccacggggtaggaaaatcaaactcctgctcagggcagagagcgggcacaggggccagggtctgctgcactgagccaggcgcgggggaggtcagccccgcccccacaccacccactgaggcagcacaggacacccacaggtggctagaccttagccatgtgggcccaaagagccgtgacttgagaaggtctcactcagaagtagaaaggggaaaccacccctaggctgtaaaagaaccccttg

SEQ ID NO: 79883 - DNA, 601 bp, Human; identical to SEQ ID NO: 29832

SEQ ID NO: 79884 - DNA, 601 bp, Human; identical to SEQ ID NO: 29833

SEQ ID NO: 79885 - DNA, 601 bp, Human; identical to SEQ ID NO: 29834

SEQ ID NO: 79886 - DNA, 601 bp, Human; identical to SEQ ID NO: 29835

SEQ ID NO: 79887 - DNA, 601 bp, Human; identical to SEQ ID NO: 29836

SEQ ID NO: 79888 - DNA, 601 bp, Human; identical to SEQ ID NO: 29837

SEQ ID NO: 79889 - DNA, 601 bp, Human; identical to SEQ ID NO: 29838

SEQ ID NO: 79890 - DNA, 601 bp, Human; identical to SEQ ID NO: 29839

SEQ ID NO: 79891 - DNA, 601 bp, Human; identical to SEQ ID NO: 29840

SEQ ID NO: 79892 - DNA, 601 bp, Human; identical to SEQ ID NO: 29841

SEQ ID NO: 79893 - DNA, 601 bp, Human; identical to SEQ ID NO: 29842

SEQ ID NO: 79894 - DNA, 601 bp, Human; identical to SEQ ID NO: 29843

SEQ ID NO: 79895 - DNA, 601 bp, Human; identical to SEQ ID NO: 29844

SEQ ID NO: 79896 - DNA, 601 bp, Human; identical to SEQ ID NO: 29845

SEQ ID NO: 79897 - DNA, 601 bp, Human; identical to SEQ ID NO: 29846

SEQ ID NO: 79898 - DNA, 601 bp, Human; identical to SEQ ID NO: 29847

SEQ ID NO: 79899 - DNA, 601 bp, Human; identical to SEQ ID NO: 29848

SEQ ID NO: 79900 - DNA, 601 bp, Human; identical to SEQ ID NO: 29849

SEQ ID NO: 79901 - DNA, 601 bp, Human; identical to SEQ ID NO: 29850

SEQ ID NO: 79902 - DNA, 601 bp, Human; identical to SEQ ID NO: 29851

SEQ ID NO: 79903 - DNA, 601 bp, Human; identical to SEQ ID NO: 29852

SEQ ID NO: 79904 - DNA, 601 bp, Human; identical to SEQ ID NO: 29853

SEQ ID NO: 79905 - DNA, 601 bp, Human
gaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatracagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccaga

SEQ ID NO: 79906 - DNA, 601 bp, Human; identical to SEQ ID NO: 39261

SEQ ID NO: 79907 - DNA, 601 bp, Human; identical to SEQ ID NO: 39261

SEQ ID NO: 79908 - DNA, 601 bp, Human; identical to SEQ ID NO: 30005

SEQ ID NO: 79909 - DNA, 601 bp, Human; identical to SEQ ID NO: 30163

SEQ ID NO: 79910 - DNA, 601 bp, Human
gcttcctgcccatctatggcagggccagatctgcaaggtttccccaccaataattctgggtcatacaggaacagaaaatagtctaatggcttattataaagctctgaggactcccattcctagtgctaggcctgatgattttccaatcatgtccaaccaggttgtccatatttattattcatggtgagagaaagagatggggagagtttcaaacagtggaaaataacttaataaccagtccataatatttagtgttgaagtgttgaatttatctctctctcttctctctctctctctctcwcacacacacacacacacactcacacacacacacacccctatatcctgcatccagccctaagctctggggctggagactttggaatttgggttgccatggacaattcactgaagggtaattgagaagggactgaatttggaaaatattttagttcatttcagtccagctcccacagcactcaacttggtactgaacccgtgtagctcattaactcaaagccctctggcttggctgtctttctctaggggctcattgccaggccctggaaggagatgaaactattggaatgggagtgggact

SEQ ID NO: 79911 - DNA, 601 bp, Human
gggccagatctgcaaggtttccccaccaataattctgggtcatacaggaacagaaaatagtctaatggcttattataaagctctgaggactcccattcctagtgctaggcctgatgattttccaatcatgtccaaccaggttgtccatatttattattcatggtgagagaaagagatggggagagtttcaaacagtggaaaataacttaataaccagtccataatatttagtgttgaagtgttgaatttatctctctctcttctctctctctctctctctcacacacacacacacacactaacacacacacacacccctatatcctgcatccagccctaagctctggggctggagactttggaatttgggttgccatggacaattcactgaagggtaattgagaagggactgaatttggaaaatattttagttcatttcagtccagctcccacagcactcaacttggtactgaacccgtgtagctcattaactcaaagccctctggcttggctgtctttctctaggggctcattgccaggccctggaaggagatgaaactattggaatgggagtgggactgtatcatgtgttgtattaact

SEQ ID NO: 79912 - DNA, 601 bp, Human
acacacacactcacacacacacacacccctatatcctgcatccagccctaagctctggggctggagactttggaatttgggttgccatggacaattcactgaagggtaattgagaagggactgaatttggaaaatattttagttcatttcagtccagctcccacagcactcaacttggtactgaacccgtgtagctcattaactcaaagccctctggcttggctgtctttctctaggggctcattgccaggccctggaaggagatgaaactattggaatgggagtgggactgtatcatgtrttgtattaacttttgcttctaaatgacacagagtagtgcaaactttgcagtttgaaaatgtcaggatactgtgtgctcatattagccatcactagcactagccctagaaagcccatattcaacatgtggcaataaatgtgctgaactggctgcaggctcagtctgctctgggagtgaatagaaggatctggaggcccctcagcttatgcattgtctaagtgcatggaagctgaacatgggggaatccagggttggggaagagaagactgctttcccttattaaattttgcttggagcctt

SEQ ID NO: 79913 - DNA, 601 bp, Human
gggctcattgccaggccctggaaggagatgaaactattggaatgggagtgggactgtatcatgtgttgtattaacttttgcttctaaatgacacagagtagtgcaaactttgcagtttgaaaatgtcaggatactgtgtgctcatattagccatcactagcactagccctagaaagcccatattcaacatgtggcaataaatgtgctgaactggctgcaggctcagtctgctctgggagtgaatagaaggatctggaggcccctcagcttatgcattgtctaagtgcatggaagctgaacrtgggggaatccagggttggggaagagaagactgctttcccttattaaattttgcttggagccttcaaaggtcctgattcttttacaaggaagccttcctatatggacctcagaaatgaccaccttaaccttaatgtacccctagggttacccttagtcctttgggtcttgggggctgtatcagcaacttattctccattgtgagcctcctgccagcttccctctctgatgtcacccccaccctgcctgagcaccagaccagcctatgccagtttacttccccacttaccttgctccccag

SEQ ID NO: 79914 - DNA, 601 bp, Human
aaatgtcaggatactgtgtgctcatattagccatcactagcactagccctagaaagcccatattcaacatgtggcaataaatgtgctgaactggctgcaggctcagtctgctctgggagtgaatagaaggatctggaggcccctcagcttatgcattgtctaagtgcatggaagctgaacatgggggaatccagggttggggaagagaagactgctttcccttattaaattttgcttggagccttcaaaggtcctgattcttttacaaggaagccttcctatatggacctcagaaatgacyaccttaaccttaatgtacccctagggttacccttagtcctttgggtcttgggggctgtatcagcaacttattctccattgtgagcctcctgccagcttccctctctgatgtcacccccaccctgcctgagcaccagaccagcctatgccagtttacttccccacttaccttgctccccagacacctgcagctgaagtgccaagcaggcttgttagtgccatcagctctgcaatcctttggactcagctaattgcctgggccagagcactcactcagccttcctgaggcctgctgagaaca

SEQ ID NO: 79915 - DNA, 601 bp, Human
agaagactgctttcccttattaaattttgcttggagccttcaaaggtcctgattcttttacaaggaagccttcctatatggacctcagaaatgaccaccttaaccttaatgtacccctagggttacccttagtcctttgggtcttgggggctgtatcagcaacttattctccattgtgagcctcctgccagcttccctctctgatgtcacccccaccctgcctgagcaccagaccagcctatgccagtttacttccccacttaccttgctccccagacacctgcagctgaagtgccaagcrggcttgttagtgccatcagctctgcaatcctttggactcagctaattgcctgggccagagcactcactcagccttcctgaggcctgctgagaacagggagctgcgcctttgtgtctttattggatttcttggtcctggtacccatgacggattgtgtggaaacaaaggagagagagtgccagatcttagatccactgatgaatcaacgtcaacagttttaaaaccatcccagcctggtcccacagtcctcctctttgtcccattggttgggatgggtcactatctttgccatttggcagg

SEQ ID NO: 79916 - DNA, 601 bp, Human
tgatgtcacccccaccctgcctgagcaccagaccagcctatgccagtttacttccccacttaccttgctccccagacacctgcagctgaagtgccaagcaggcttgttagtgccatcagctctgcaatcctttggactcagctaattgcctgggccagagcactcactcagccttcctgaggcctgctgagaacagggagctgcgcctttgtgtctttattggatttcttggtcctggtacccatgacggattgtgtggaaacaaaggagagagagtgccagatcttagatccactgatgmatcaacgtcaacagttttaaaaccatcccagcctggtcccacagtcctcctctttgtcccattggttgggatgggtcactatctttgccatttggcagggtctaagtggggaccaaggcaccaggctgagttcttaaaggcacaggtgcagcagcttcccggcatgcttgcagcagcgcatggtgggtgatttctttggttttcagagggctgccacaccacacttgctggctggggcactctcatttttctcattatatcctgagcagaatggcaggaaccagagcaagcattgattgg

SEQ ID NO: 79917 - DNA, 601 bp, Human
cggagtgctgccagatggacatggtggccattcacaatggttttggtgtagcccacttagcacaatcatcatgagggcagaagcagggagaatggtggataacagagaattgcaggtgagacacagtgagccttcaacaacgaactctctcccaacacagccctgagaattgatgtcctctgagcctggctgggtcaaatgctgatggctctatgattcataaagttgtgctgatttgatatatcttttctgcatatgtgaaactgggactttgtagggtggcagaaagaataatctctcygcttctggttccatgctatttttcctgcatggaaacagaacagactttcattatggccagggaactgtattttcttggctttcactttgcttctgtgaaaccgtctcctgtcaaagtcgtggtgaccagtcgcttggctgtgcagaggcacctggagaccaattagacagcacagccagcaaagagtggtcctggcctagagctgtttctgttgtgaagagcgtgggtggtgagaagagaacaggtgagaggggagtagaggaagctatggggagaacttgcgcattaggatgtgtggca

SEQ ID NO: 79918 - DNA, 601 bp, Human
aacctacatgtaaattccttcatgcctggaaacccaggggacattttgaacctttcaacagtttctgcacctttgtcagcttgagcagctgagatgagccactttataagcctgggggagttgagatgaaaaatttgcaggatttgaaagtggaaaaaatacatctaatttaactcttcttggaaaaagaggttttcggggcctgcttccatctcccttagggttgctggtcccagctctgggttccccctgcctcctcatcctgagctgctgaaagagaaggtgaggaacacaagggggwgtgtgtgtgtgtgtgtgtgtgtgtgtgtgtgaggcctcagtgctggaagccacattcaagggcaccaaggagccctctctgctctctcagtcccatcagctattggctggtgagagggaaaccacagcccagatagcctcctctcaagctccagggagaccggctgtgttcagggccaggggaggccagggtcattaacaccgcagccctgtaacatgagcttcataataggatttcccaacaggctacttcatttagaaacctctcgggcctcctctgctccccatggcggccctaccc

SEQ ID NO: 79919 - DNA, 601 bp, Human
cctacatgtaaattccttcatgcctggaaacccaggggacattttgaacctttcaacagtttctgcacctttgtcagcttgagcagctgagatgagccactttataagcctgggggagttgagatgaaaaatttgcaggatttgaaagtggaaaaaatacatctaatttaactcttcttggaaaaagaggttttcggggcctgcttccatctcccttagggttgctggtcccagctctgggttccccctgcctcctcatcctgagctgctgaaagagaaggtgaggaacacaagggggtgwgtgtgtgtgtgtgtgtgtgtgtgtgtgtgaggcctcagtgctggaagccacattcaagggcaccaaggagccctctctgctctctcagtcccatcagctattggctggtgagagggaaaccacagcccagatagcctcctctcaagctccagggagaccggctgtgttcagggccaggggaggccagggtcattaacaccgcagccctgtaacatgagcttcataataggatttcccaacaggctacttcatttagaaacctctcgggcctcctctgctccccatggcggccctacccag

SEQ ID NO: 79920 - DNA, 601 bp, Human
gagggcaatctgaggctcaccagggaagaaaaggctctgaggctttgtgcttacaggaaagggcagagggaaggaagggagctgtggactgggggattgtgtttctcttatttgtatcaaggaccctgcatgggcctgtgagggctgtatcccagctcagtcagggctgttgtcagacttatcctttgcttttggtccccatctcttgctgtggctggacagtcccttcctgcagaatttgagcacaaacatctgcaccttttttttttttttttttttttttttttttttttttttttttcatggacggagactcaccacttttcagtttgaaagatggagatgaaaaattatactgaatccaagcctgcctgcagtggagtcttttggttctgggcccttaggagccctgagagatctgagttctgtttccactgctttgggccattgatgagttgaattgatagggccttaagacctgggtctcaggtctccctcagtgcagtagggtgaagaagactggaaagagtaacttgagggctgttgcaaatggagaaggaatgcacctcaaacactggcaaaccacccaggaacaagcctt

SEQ ID NO: 79921 - DNA, 601 bp, Human
cctcaaacactggcaaaccacccaggaacaagccttattttgccaacaggtctttgacaggcatgttgagagaggtgcaaccttgcctttccctacaggctgtaaatgttcaggctaaacaaagagcttgagtgctagttacctggcaaggcagttgagcccccatttttgtttcaagggcctgttaataatactgagaaggcaaagtctggggagatgtggtttagtccagaagagtatggctgggtatgttttgggtcccagaagctatccataagacagagagtatctcatcttcctktgtacccacctagcctgctgcaggatgagtctgtgaagctgcaagtgtgttcgactcatcctcttgtgtatgtatgaccagggaggtcaggaagaaatgagcttagctacaataggcccctggagaggctggtgagaaggaggcgttgttgagagcctcaggaagcctcttgaaatcactgggcataaatttgggccagcaaggccaaacccagccctgatgaatcttttcattgaggataggacctagttcattagaaaggctgcagaatgaaataggcattttggtttctggcttttc

SEQ ID NO: 79922 - DNA, 601 bp, Human
agaaggcaaagtctggggagatgtggtttagtccagaagagtatggctgggtatgttttgggtcccagaagctatccataagacagagagtatctcatcttcctttgtacccacctagcctgctgcaggatgagtctgtgaagctgcaagtgtgttcgactcatcctcttgtgtatgtatgaccagggaggtcaggaagaaatgagcttagctacaataggcccctggagaggctggtgagaaggaggcgttgttgagagcctcaggaagcctcttgaaatcactgggcataaatttgggscagcaaggccaaacccagccctgatgaatcttttcattgaggataggacctagttcattagaaaggctgcagaatgaaataggcattttggtttctggcttttccctggcctctgtctggagtagactactcagcttcagggtctctacatcagcacaccacacattcctggtcagagctggagtcactgggtcttagggtatggtccttggaggcccactctgatcatttctttgcaggcctcagcagttatggccttctccttcctcattcaaattggattccactctttaggtcatg

SEQ ID NO: 79923 - DNA, 601 bp, Human
agacagagagtatctcatcttcctttgtacccacctagcctgctgcaggatgagtctgtgaagctgcaagtgtgttcgactcatcctcttgtgtatgtatgaccagggaggtcaggaagaaatgagcttagctacaataggcccctggagaggctggtgagaaggaggcgttgttgagagcctcaggaagcctcttgaaatcactgggcataaatttgggccagcaaggccaaacccagccctgatgaatcttttcattgaggataggacctagttcattagaaaggctgcagaatgaaayaggcattttggtttctggcttttccctggcctctgtctggagtagactactcagcttcagggtctctacatcagcacaccacacattcctggtcagagctggagtcactgggtcttagggtatggtccttggaggcccactctgatcatttctttgcaggcctcagcagttatggccttctccttcctcattcaaattggattccactctttaggtcatgcgggttggatggtcccatgtcttttctttcttcagctacttattgggcaccaactggtactgggccctgtatgcttatat

SEQ ID NO: 79924 - DNA, 601 bp, Human
gaggatgctgtggctgcaagtggtgctgttgctctggagaacctgatggagcatggccacatccggctagataaagcctcgaaggacagcgagtcaagcacaccccatgaccccactttgctcttccacagtggtcctcagcctaattttagacacttccagggatggaacaccgttacttccgaaggaagcctggttaatttctgaacctttcttccttggggtggaacttttatacaaatctccactcatgcaatttacctttttttgttgttactaaaaacattttgaacaggtaatrtatgtgaaaggtcagtttccctccactctggttgtcatcagtctctctcattgtcagtttctaatattctcttgcagagagtcgatggatttgtacactcttcccccttgcataggggcacactacagaggactttgcacctagtttccccacatctcttctcagttaacactgaagtttaacagtagtttggttatattacatatagatctgcctcattctttccaatgagtgttattatttcattgcatggatatattttacttaattggtcatttatatacatttagattgttttct

SEQ ID NO: 79925 - DNA, 601 bp, Human
tctctctcattgtcagtttctaatattctcttgcagagagtcgatggatttgtacactcttcccccttgcataggggcacactacagaggactttgcacctagtttccccacatctcttctcagttaacactgaagtttaacagtagtttggttatattacatatagatctgcctcattctttccaatgagtgttattatttcattgcatggatatattttacttaattggtcatttatatacatttagattgttttctctcttttgctgtttctgaacaatgttgcaacagatatccttrtgcatcagtctttgcacctatatgtgagtatatctgtgagaaaaattaatttatttattcaatgaatacttattgaggattttctatatgccaagcacttttctaagcactaagaatgcagtaaattctcagaagtaaaattgctgaataagaatatataaatttttaattttggtagatattcccaaattgtcctccccaaaaaggcattttctaccaatttttgttcccaccagcagtgtttgagagttcctgttccctatacctttgccaagataataaaatatcaatcatttttat

SEQ ID NO: 79926 - DNA, 601 bp, Human
tgccgcatgcatctctcagctctcaccctttggcccttcaccccacatcctttcctttaattttcccagcttacctctggggcctctagcctcagctcaccatgttgacacctccatagccccgccttcctagatcgccagccctctgccctcccctcctcctgccccctcttcatttcttcagccttcaccagacctgccaccccttccccagcagccccaaatcagtctcatccccttccctgaccaggtgtctaccctctactggagcatacaccttccactctgctgaagcccaggycttgtctctgccaggggtgttggctcagctctgggctgttgcttgctgcagctatgcatatgtctgtttggtttttgtccccctgctctgtggcagctctttctatctggggccatgcactccctacttctcttacttacctcagtttccctttcccctcccttcccctcctctcccttcttataccttctcttgctccttccttccttccttccttccttccttccttccttccttccttccttcttccttcttcttctgtacttttgttttaaagtgaaaatattcatgttaaaaagt

SEQ ID NO: 79927 - DNA, 601 bp, Human
tccttccttccttccttccttccttccttccttcttccttcttcttctgtacttttgttttaaagtgaaaatattcatgttaaaaagtgagttaatttaaagaaaaataatgaataataataatacatttaaaacctgccacatataagtatggcaaaaaggaataaagataataggcaaacagctgatatttgaaaagaatgctgatgctctgtttacctgggctaggagagcagcttatgcactcttcagtgtagccccacattccactgccactgatggttgtatgatggttataacstgggtatggagcacacttctggattggcttccatcttgtgtcgaaatgctaatacagtgtggctgtcatttataaagcagtgacggtgtgctagatgctctgccaaattctttttctgcattaactcttaaatcctcacagagctttatgaggtacatgtgattattagcctcatttttccattgaagataccgaggcaccgagaaggtaagtaattttctcaagatcatacaacacaggacttggaggttctgctggtaaccactattctctatgcctcccaagctaaagaagagccaa

SEQ ID NO: 79928 - DNA, 601 bp, Human
tgctgatgctctgtttacctgggctaggagagcagcttatgcactcttcagtgtagccccacattccactgccactgatggttgtatgatggttataacctgggtatggagcacacttctggattggcttccatcttgtgtcgaaatgctaatacagtgtggctgtcatttataaagcagtgacggtgtgctagatgctctgccaaattctttttctgcattaactcttaaatcctcacagagctttatgaggtacatgtgattattagcctcatttttccattgaagataccgaggcacmgagaaggtaagtaattttctcaagatcatacaacacaggacttggaggttctgctggtaaccactattctctatgcctcccaagctaaagaagagccaagatttgtaatttttgatgggagttggcatcagcattccatttggactaagatgtaagccttcactaacatgcacaaagaaaagtcatcagaatttgatctacatttggggacttcacggatagtgttcatttcccattggtaagggatgaaccaggaagttcatggagtgatcatattcaccagtgagagtgaactgaagt

SEQ ID NO: 79929 - DNA, 601 bp, Human
tgtcgaaatgctaatacagtgtggctgtcatttataaagcagtgacggtgtgctagatgctctgccaaattctttttctgcattaactcttaaatcctcacagagctttatgaggtacatgtgattattagcctcatttttccattgaagataccgaggcaccgagaaggtaagtaattttctcaagatcatacaacacaggacttggaggttctgctggtaaccactattctctatgcctcccaagctaaagaagagccaagatttgtaatttttgatgggagttggcatcagcattccrtttggactaagatgtaagccttcactaacatgcacaaagaaaagtcatcagaatttgatctacatttggggacttcacggatagtgttcatttcccattggtaagggatgaaccaggaagttcatggagtgatcatattcaccagtgagagtgaactgaagtcactgtcactgcacctgtcacctgcatcatcatgcccagctcacattcccgttcctctactccctaagctcctcaggggcagtggccatgcctgatgcatctctgaatccctacttgctctgtgccatctgttaaatg

SEQ ID NO: 79930 - DNA, 601 bp, Human
aaggtaagtaattttctcaagatcatacaacacaggacttggaggttctgctggtaaccactattctctatgcctcccaagctaaagaagagccaagatttgtaatttttgatgggagttggcatcagcattccatttggactaagatgtaagccttcactaacatgcacaaagaaaagtcatcagaatttgatctacatttggggacttcacggatagtgttcatttcccattggtaagggatgaaccaggaagttcatggagtgatcatattcaccagtgagagtgaactgaagtcacygtcactgcacctgtcacctgcatcatcatgcccagctcacattcccgttcctctactccctaagctcctcaggggcagtggccatgcctgatgcatctctgaatccctacttgctctgtgccatctgttaaatgaaaacagaacaaaacacactgaaaacaaaatttgtggaaggagaatatgagctgagaagggagagtctttgcattaggatgtataagaaaatatcccagcagcattgagtagagggagctccgaagaaactggggaggaatcgggcacaaggcatgcacttgtgga

SEQ ID NO: 79931 - DNA, 601 bp, Human
gtgcaacgtgtgtatttcaagtgggaaatgacaatctgctctttgcacaagatggatagagcttctcattgaaattgtatggaatatgcaagaactctgccaaatcatgaacttggcaaaaatgtgcctgttctgggaattaggcgatttcagggcttccatttggtttctgggtctgtcacacacatgcccacatggatctgaatgtggaggcccttgtgacttcaggctttgctttgcttttctcactggctctgtttgtcttttccctctgcatctttggtcaaatttgtctactctrttttctcttcttttcctccatttattccgttctcttgtctgtcttctctctagacttgtttcgaaaagagggaaaagaaacatacatttcattgatagaattttaatgagtgaatggctatttccattcattgtttttattttgtctctaggagtctgtcttgatgcgaattgcaattttaaaaatgaactcttttaatagtaaaatacaggaaatcaatgattatcattgaatcaatagcaaatattacaagtgattttgtcatcaaaatgattaataatcacacattttgataaaaga

SEQ ID NO: 79932 - DNA, 601 bp, Human
gacaatctgctctttgcacaagatggatagagcttctcattgaaattgtatggaatatgcaagaactctgccaaatcatgaacttggcaaaaatgtgcctgttctgggaattaggcgatttcagggcttccatttggtttctgggtctgtcacacacatgcccacatggatctgaatgtggaggcccttgtgacttcaggctttgctttgcttttctcactggctctgtttgtcttttccctctgcatctttggtcaaatttgtctactctattttctcttcttttcctccatttattccrttctcttgtctgtcttctctctagacttgtttcgaaaagagggaaaagaaacatacatttcattgatagaattttaatgagtgaatggctatttccattcattgtttttattttgtctctaggagtctgtcttgatgcgaattgcaattttaaaaatgaactcttttaatagtaaaatacaggaaatcaatgattatcattgaatcaatagcaaatattacaagtgattttgtcatcaaaatgattaataatcacacattttgataaaagatcattaattaaaaagaacagtagctttta

SEQ ID NO: 79933 - DNA, 601 bp, Human
ctctagacttgtttcgaaaagagggaaaagaaacatacatttcattgatagaattttaatgagtgaatggctatttccattcattgtttttattttgtctctaggagtctgtcttgatgcgaattgcaattttaaaaatgaactcttttaatagtaaaatacaggaaatcaatgattatcattgaatcaatagcaaatattacaagtgattttgtcatcaaaatgattaataatcacacattttgataaaagatcattaattaaaaagaacagtagcttttaaaaattttaaactgtcttygtaggatgccttccttcttcagtctcattatttttctggagcattctttgcttccttcaccttcttcagccccattcttgattactcttggcttatgagaattatttcaagcctcccttttcttctaacatattttgaatctttcattccagatactcattaagaaccagtagccaaagctgttcattgttgaattttacatacctgatgagagtgactgcttccaccttgcaggatgacatgttccttcccctgctctacctaccctgcctatctctgcctacctaccctgcccacttc

SEQ ID NO: 79934 - DNA, 601 bp, Human
atagtgccactgtactcctcccgcctgggtgacagagtgagaccctgtctctaaaaagaaagagaatttcctctaataaaaacaattattttggagagtgttttatctgtggagattgattttttcagtcattttctctctgacccacatcaaagggtcgactacccttctgcccgcttgtagagagagcctaaattcgagttaaccatgtctaagcagtgcagcagccctcccgcccccacctccaccttgaggaccttctgcagccctggaggctaccgattgactactcagagagctsatagcctcagtgcacaaatcacactgacttggacatccacacaaccacttctttgggaggcagaagtgcctgcatctgcgcatcccaggggttggtggccttgactctctgatctgcttccccagtggccaggcctcttcagatcttttcccatctcctgccttccctgcctgtagctgtgcactggcccttcctttcaggccacaaagagctctgtagacagaagctgtgtgctgtttgccaacactgcactgggtatacagaggggcaagggagaggccatctgctcgctcctttcac

SEQ ID NO: 79935 - DNA, 601 bp, Human
tctgcagccctggaggctaccgattgactactcagagagctcatagcctcagtgcacaaatcacactgacttggacatccacacaaccacttctttgggaggcagaagtgcctgcatctgcgcatcccaggggttggtggccttgactctctgatctgcttccccagtggccaggcctcttcagatcttttcccatctcctgccttccctgcctgtagctgtgcactggcccttcctttcaggccacaaagagctctgtagacagaagctgtgtgctgtttgccaacactgcactgggtayacagaggggcaagggagaggccatctgctcgctcctttcacacagacctttgctttctccctttcactctcctccttctctctgtctttgaatgagaatacaaaaattttttaaaagcagttgctaattagagcaagagaatgagagtgagcctggaagagagacacaacagagaggccagcccccgtgcaaatcagccggcttttaagagccagtgaggaaagggacaaggagggggccttgaaggggcttgggaaggatattatgacaaaataagcaacaaagcttcttcagaatggc

SEQ ID NO: 79936 - DNA, 601 bp, Human
ctgccttccctgcctgtagctgtgcactggcccttcctttcaggccacaaagagctctgtagacagaagctgtgtgctgtttgccaacactgcactgggtatacagaggggcaagggagaggccatctgctcgctcctttcacacagacctttgctttctccctttcactctcctccttctctctgtctttgaatgagaatacaaaaattttttaaaagcagttgctaattagagcaagagaatgagagtgagcctggaagagagacacaacagagaggccagcccccgtgcaaatcagcyggcttttaagagccagtgaggaaagggacaaggagggggccttgaaggggcttgggaaggatattatgacaaaataagcaacaaagcttcttcagaatggcaaagagggctttgtcttaacctcctatcataaaaggggaggaaacaagaaatgacagagagtttcttgtgaactccctctgcaagcctccacctaccctggctcttcttgtcttttttactcactcaatagcctagtaaacaatagtctctatttagggacatttaagtgtatccttttattgataatttttgttctgg

SEQ ID NO: 79937 - DNA, 601 bp, Human
ttataatagttatattacaatggttgtattgttaccatttggccatctctcttgagtccctcaccatgtgatgccctgcaccacttcagggctctgcagagtccccaccagcaagaaggccctcaccagatgtagcaccttgaccttggaactcccagccttcagaactgtaagaaataaattgctttttctttattaattacctagtctcaggtttttagttataacaacagaaaatggactaagacaaaaggatgataattgatttatcctctttcactggtgactttttaaggtgatggatgcacatgagaagaatatcccactggagtctgttggaaaacatctgctcattctaagatgaggtctcaaagtggacttttcaggagtccacactcagtggacctgtctctaacacacaggtgtgtttccctgaaccctcagtgcagtctatcttggccctgtccaaggacctctctagaaaacaaggacatgagtccatttgccatgcaactagccagggtggaaaaagctgtagagaaaacagccatagaagtatagttttaagagctggcagcttgagttgttgaatcctggctct

SEQ ID NO: 79938 - DNA, 601 bp, Human
caaatacccaggcaagctcttattgagtcatatggaaattgtatgtttaactgctagatcagttttcagggtgcctgtaccattttccattaccatcagcatcagtgtgagtttcagttgttctgcctttttggcagcacttggtattatcagtattttttatcttagccattctactatgtgtgtcatggtatctcatggtgatattaatttgcatttctctagtaaatcatgatgttgatgatctttcatgtgcttgtttgccatctgtttatgtttatcctcttttgtgaagtgtctsttctaggtttttgcccaagtttcaattaggttgtttgttgtctttcttgaaagaaaggaaaagaaggggaaggaagggaaaaggacaggtgaggagaggctgcctcttctcttagaggagccctgggaggcaggtgtggccatgaggactggtccacacaggggagagccaattcttagacacgctagtttctgtttctgatctgtgatgaaggccttcatttaaggaagacatctcagccagctctgcttgggcttcttttctgtgaattattataagtgttaatgggagtcttcatca

SEQ ID NO: 79939 - DNA, 601 bp, Human
aatttttgtttaaggcatgcagctcattttatcatcattttgcctgtgatgtccaattatttcaacatggagagagctgtatgagtggctctttcactttttccaagcctttacttgaatattatgttctcaggaaccctaccctgtccactgctcccagtgtgaatcaccttcaacagcctcccatctccctccatggctttgtcttacttcatggcacttattatagtgtgagctttactgatttatgatgtgtattgtctgtctctcctcactagtatgtaggctatatgaggacagsggtatttgagtgtgtatgtgtgtgtgtatgtagggaaaggatctgcttgttaactgatgtatcctgagtgattagcacgtatttgaagaatgaagaggctggagtcccctaggccacacggctgcagaggtccacagtgcagggacagttgctggggctccaaggccagcagcagctatcagatgcgagctggactctgtctcacacgttcatcaggcaaaacaggtttgtcacagttaatgctccgaagctcttctctcactcacccgcctaccatattgaatgaggctaataagaaca

SEQ ID NO: 79940 - DNA, 601 bp, Human
cagttaatgctccgaagctcttctctcactcacccgcctaccatattgaatgaggctaataagaacataagcaattaaaccattttccccatcagtcttaaattatttgttccttgaaatataagctttatccttttctcaccccgatacctcttgaaagaaaggaagtgctctaatgccctgggaaaataatcttaaattctaatcagccctcaatcctgggtgttagaagtgactcatagatgaggtggtgggcaggatggaggggaaagctgtttaggaggcaaagtcggctagaatrgaagctttcaactgactaacagtgcttcaactccaacaatgaggcttaacttatcaagtgtggggcccagggaatctgagatgcaagcagcacaaagatacagagagaccagaagaaaataaagcagattaaataaactgggagtgggtttagtggattcttgttctctgcaaatggagctcctcctcttcattctgaccctaccctgagttccaacttactttcctcaccagtggcatcattctgcccttggtctttccagtagcaggtagagtcgatgcgtgacattcagtctccctg

SEQ ID NO: 79941 - DNA, 601 bp, Human
agctcttctctcactcacccgcctaccatattgaatgaggctaataagaacataagcaattaaaccattttccccatcagtcttaaattatttgttccttgaaatataagctttatccttttctcaccccgatacctcttgaaagaaaggaagtgctctaatgccctgggaaaataatcttaaattctaatcagccctcaatcctgggtgttagaagtgactcatagatgaggtggtgggcaggatggaggggaaagctgtttaggaggcaaagtcggctagaatggaagctttcaactgrctaacagtgcttcaactccaacaatgaggcttaacttatcaagtgtggggcccagggaatctgagatgcaagcagcacaaagatacagagagaccagaagaaaataaagcagattaaataaactgggagtgggtttagtggattcttgttctctgcaaatggagctcctcctcttcattctgaccctaccctgagttccaacttactttcctcaccagtggcatcattctgcccttggtctttccagtagcaggtagagtcgatgcgtgacattcagtctccctgggttctgctctggaa

SEQ ID NO: 79942 - DNA, 601 bp, Human
tccaacttactttcctcaccagtggcatcattctgcccttggtctttccagtagcaggtagagtcgatgcgtgacattcagtctccctgggttctgctctggaatttataggaggagcttagggacaacagtctggatggatgggtggatggagcgagggcagctgggctgcatttgcacagcaagcacactgttcttaatgtgaatgtttatttgtagtgcagggagcactgatgggaataggatgagaggcaggccctggctggtgagggctggtgtgaagcatctgcagaggttgctrgtccttctccttcctcaatgcagggacactagtccctttaggtaccatcccatctcccaccccagcatgatgccctgcagatgcagcagatcctgtcaaacagccctgctctttgattatctctgaacagctaaggctcctggcctgtttgaaattgggtcacatactgtttgttctcagaaaagcaaactcatgttgtcttctatttccatctcatttccagcactggattgaccaagtgggctaaaattcttttttgataaatttgtttcagttcaatgggaggagctgctgattttt

SEQ ID NO: 79943 - DNA, 601 bp, Human
ttgctgtgacaaccctatttggacctagagtctgggtgggtgggcagctctgacagagttatgtcccttgtgttcctgcacatcccaggttgggcctcagctgcccatctctggcccaggggggttggtctggcttcccttcttgctccctccacagcctggataggtgttccagcaataaggcattggagtctgattcagatcatagataaatctggcacagttacttacctttcttgggtgtggggaatgtgtcctcctgcaggagctccagctgtggcacaccctgtagtctcaggtstgcagccctttccaagggcagacacacaacaacaggattgctttctctggctgtgttcactggctcccttgccttcttcagggatggggacagtgagaacctgatagtgaagggcagggttgaccaacaaggtccacagcaagtttctggctcagcctggaagagatgcccctgcttctttaaccaatggtaggtctggcagtgggagaggaaccgagcagaagcactccttgtctgtcttctagtctttttttttttttttttttttttgagatagagtctcactcccgttgctcaggc

SEQ ID NO: 79944 - DNA, 601 bp, Human
ccttcttgctccctccacagcctggataggtgttccagcaataaggcattggagtctgattcagatcatagataaatctggcacagttacttacctttcttgggtgtggggaatgtgtcctcctgcaggagctccagctgtggcacaccctgtagtctcaggtgtgcagccctttccaagggcagacacacaacaacaggattgctttctctggctgtgttcactggctcccttgccttcttcagggatggggacagtgagaacctgatagtgaagggcagggttgaccaacaaggtccamagcaagtttctggctcagcctggaagagatgcccctgcttctttaaccaatggtaggtctggcagtgggagaggaaccgagcagaagcactccttgtctgtcttctagtctttttttttttttttttttttttgagatagagtctcactcccgttgctcaggctggagtgcagtggcatgatcttggctcactgcaacctccacctcctgggttcaagcgattctccttcctcagcctcctgagtagccgggattacaggcatgcaccaccatgcccagctaatttttgtatttttggta

SEQ ID NO: 79945 - DNA, 601 bp, Human
gtagtctcaggtgtgcagccctttccaagggcagacacacaacaacaggattgctttctctggctgtgttcactggctcccttgccttcttcagggatggggacagtgagaacctgatagtgaagggcagggttgaccaacaaggtccacagcaagtttctggctcagcctggaagagatgcccctgcttctttaaccaatggtaggtctggcagtgggagaggaaccgagcagaagcactccttgtctgtcttctagtctttttttttttttttttttttttgagatagagtctcactcycgttgctcaggctggagtgcagtggcatgatcttggctcactgcaacctccacctcctgggttcaagcgattctccttcctcagcctcctgagtagccgggattacaggcatgcaccaccatgcccagctaatttttgtatttttggtagagacagggtttcaccatgttggccaggctagtctcgaactcctgacctcaggtaatccacttgccttggcctcccaaagtgctaggattacaggcgtgagccactgcacctggcttgtcttctagtcttaaaaaataaattatctgagca

SEQ ID NO: 79946 - DNA, 601 bp, Human
ctttttttttttttttttttttttgagatagagtctcactcccgttgctcaggctggagtgcagtggcatgatcttggctcactgcaacctccacctcctgggttcaagcgattctccttcctcagcctcctgagtagccgggattacaggcatgcaccaccatgcccagctaatttttgtatttttggtagagacagggtttcaccatgttggccaggctagtctcgaactcctgacctcaggtaatccacttgccttggcctcccaaagtgctaggattacaggcgtgagccactgcayctggcttgtcttctagtcttaaaaaataaattatctgagcagaattaaaatgccaagggttggtaggagtgggatagggtagggcttgtcaaaaagccttgggagaaagcatttccggaatactcaatcctagagaaaatctctgcagctgcaggattcaaggcttggcctggagagtataccttattcctttagggaaatgctgagaggttttgtctgacctggaaaaacaagaggagcatgtctgcaggagagaggacccaaaggccagcaggaagttggtgatttggctggaaggca

SEQ ID NO: 79947 - DNA, 601 bp, Human
cagaattaaaatgccaagggttggtaggagtgggatagggtagggcttgtcaaaaagccttgggagaaagcatttccggaatactcaatcctagagaaaatctctgcagctgcaggattcaaggcttggcctggagagtataccttattcctttagggaaatgctgagaggttttgtctgacctggaaaaacaagaggagcatgtctgcaggagagaggacccaaaggccagcaggaagttggtgatttggctggaaggcaagtcttcagagagtgctgtgaagtgatatagagctgcatmtgggctggaggaatatcccatttctctgcctttatcctttatccagtcacagtggtctctgaccacaccctagttcatctcctctccccagatacatcttcctaaatccaagactcagtcacaggtaagcattcaaggatgcacacgtgcgcacacatacatacacacacacgcacacaaacacacacacatacacacacgggccccaaacccagtttgtttaagagtgtagactctggagccagactgcctgggttggaactctggtgctaccacttactagctgtatgaccttggggt

SEQ ID NO: 79948 - DNA, 601 bp, Human
gagtttggtggcagagagccttgggcagggcaggggatgcagaactggggtggatttctgggtaaggctaaagagcatgtacagagagtgagcaaagtcaaaacagaaatactataggctgtaagagagtgaagggtaggcttagggggaagaatagtggtgggaatttgctgtggggggccacagctcctgatactctgctactctggcatcagagacagcctcccaggactgtctcccctagcccctcatgcaacacatactgacccaacacccagcaccaatgtactgcctggtcctrtactgagggctttgcttacatgatctcatttaatcttaccaataacttcaggaggcaggtcacattatttacatctcactttatggataaggagtcattataggcataggttaaagttagtgaagaacagtgttttttttttaaactattcgtaaggatagaataatagaaagatttaagagggcagggggggagtgagaaagacaacatcttgcctcctaaagggcatgtgcagatgcatacatgtgcacacatattggccacattaaatcttctggagatgaggccagacatataaaa

SEQ ID NO: 79949 - DNA, 601 bp, Human
ctcctgatactctgctactctggcatcagagacagcctcccaggactgtctcccctagcccctcatgcaacacatactgacccaacacccagcaccaatgtactgcctggtcctgtactgagggctttgcttacatgatctcatttaatcttaccaataacttcaggaggcaggtcacattatttacatctcactttatggataaggagtcattataggcataggttaaagttagtgaagaacagtgttttttttttaaactattcgtaaggatagaataatagaaagatttaagagggcagggggggagtgagaaagacaacatcttgcctcctaaagggcatgtgcagatgcatacatgtgcacacatattggccacattaaatcttctggagatgaggccagacatataaaaacaaacaaacagaatcaagccactagatgaggatataggatgaaagggaaataaagacagagaaataagatgatatgtggctgaaggtcctgacacccataaccagaagtgggtggattaacagaatgcagaatggaacaggcacctggagggagtctgccttggcctgggtcctggatggggtat

SEQ ID NO: 79950 - DNA, 601 bp, Human
atctatgggagcagctagggaggagcaggcacagatgtcatctgagagattccagggcaagagcagagaggaggcgccaaggacaggatgggatgaatgcaacagctcctttgcactgcagcctggcagccccctggcaaatgcaggagaacagctcctcacctgactcaataaaggcagcactgggcagggtcaattcaccaggaagttgaaaggtgatcaaaccacactgagatgacaggaaacctttggcctgcttgctaactttctaatatcatcaaagataaatctaattttgtcrcaggacagtttgtcttgtttggtttgaaacattcttgctctcctttttatctagcgagcttctctggtgttgcatctcagcttagggttcactttctccagatgtcaccccatctcctcctctatgcatctgtaacacccatcatggcccaaacatttcttctgtgatgccacatattcttccataaacaaccttatatgcaaaactgcactccaaatagcagtgcttatggggttaaaaaaaaaggttagggcttgtccttcaacacctgcaggagtttgtatcaaaagccctaagaaa

SEQ ID NO: 79951 - DNA, 601 bp, Human
gttagggcttgtccttcaacacctgcaggagtttgtatcaaaagccctaagaaaaacaaccatcctaatagaaacagcagctcagataaatctcttgcacccagcctcccagtaggtggagactttgtggccttgaactctggggctctgccttctccttggaaatgtaggtgctagagggcattcatttctatttgaaacccagttcatcaacattacaactctgacaatttttatttgacaattttacttcaataaagctgaggaacaattctgaaatttccttgaggatgttttcacrcaggaggaatgtctttgtagcttctccatctgcattttcaccttcacagcttagcagaatggtggagtagaggtgcttgaagcctccaaaccacccacaatgtacactagaggaggcacttgtgcagactttcagcttgtgcttcacactcctcaaggcaccgccactgttgcgagtggcctgggatgtgaaggagaatgccttggaaaatctctagctccaggcctgtggcctttcagcaaggtgtgctctgggaggggtggatggacctgcagaaaatccatcttcacgaagaatgga

SEQ ID NO: 79952 - DNA, 601 bp, Human
cagagcctcctgccgtcccagccctggttctacctgtgaaggagagaatggaaggaggcacttgcctgatgccatccattctgtttttctttccacagtgtccaggcctttttggaggatccttagacagcaggattgacattggaggagcctggtatttctgccacactcacacagcctcctctgcatccaccccctctgaggaagcaggtgacttgcttgtggagcctcaaaaatggaagatccaagttttccctttctcccctcagaagccctccactcctgcaatccactgagttaccaagtcctatccattccactgtggaagagctcaaccttccctttctctctgctgcccctaccctaagccactgtagttgggctctctcttgtcttccgggatcctgccctggcccctcagtgcatcttccacatggttgctccagggattttcccaaaaagtaaagctggtcctgtcgacctatgggaggctcttctttagatgtcttcattactcccataaaaaagtctgaaaaccctgccttagcaccagggcatttagcaatctgcccccacccctcctctctagctccatctcctg

SEQ ID NO: 79953 - DNA, 601 bp, Human
ctttcttgggttttctcctccatgatgttgtcctcatggagggtggggccaggggccttggggtctggcatcccaaaaccaggcaaacacttaggatttctggcctcataatgtggcttataaaagcttccaaggaaacaaaatcaaaatgttagaggatttttctttggggaaataattactctcatcttatatttagaatggtacagtgtcttctactttgtgatttgactgacagagaagtgtatttgaactatttttaacttggaatattaagaagaagaaatcaagtgattagatcttggaagctattgtataattcttaaactttggtaaaggagcatgttcaaagggggaaaaaaaggccaaccagattggcacgtttcagttctttctgtgactttagacttttattccaaaggaatccattgtctttagaaaggcagccaaggatgtgcctgtgtatgtttgtgtaaaagccactccattctccataaatagcttcagattatggtcttcacttcaagaagacattttagaaagggcttctctcactccattgacagcaacagtgagcgtttgtacagggctaagcaagtta

SEQ ID NO: 79954 - DNA, 601 bp, Human
tctggcctcataatgtggcttataaaagcttccaaggaaacaaaatcaaaatgttagaggatttttctttggggaaataattactctcatcttatatttagaatggtacagtgtcttctactttgtgatttgactgacagagaagtgtatttgaactatttttaacttggaatattaagaagaagaaatcaagtgattagattttggaagctattgtataattcttaaactttggtaaaggagcatgttcaaagggggaaaaaaaggccaaccagattggcacgtttcagttctttctgtractttagacttttattccaaaggaatccattgtctttagaaaggcagccaaggatgtgcctgtgtatgtttgtgtaaaagccactccattctccataaatagcttcagattatggtcttcacttcaagaagacattttagaaagggcttctctcactccattgacagcaacagtgagcgtttgtacagggctaagcaagttacactttcccatttgctttttaaacaatcttataagggagttactacagatggcccccaacttacaatggttcaacttatgatttttcaactttataat

SEQ ID NO: 79955 - DNA, 601 bp, Human
tactctcatcttatatttagaatggtacagtgtcttctactttgtgatttgactgacagagaagtgtatttgaactatttttaacttggaatattaagaagaagaaatcaagtgattagattttggaagctattgtataattcttaaactttggtaaaggagcatgttcaaagggggaaaaaaaggccaaccagattggcacgtttcagttctttctgtgactttagacttttattccaaaggaatccattgtctttagaaaggcagccaaggatgtgcctgtgtatgtttgtgtaaaagycactccattctccataaatagcttcagattatggtcttcacttcaagaagacattttagaaagggcttctctcactccattgacagcaacagtgagcgtttgtacagggctaagcaagttacactttcccatttgctttttaaacaatcttataagggagttactacagatggcccccaacttacaatggttcaacttatgatttttcaactttataatggtgcaaaagtaatatgtatttgtgtagaaaccatatagattaaactatgatgttaggtgtattaaatgcattttcagctt

SEQ ID NO: 79956 - DNA, 601 bp, Human
tttataatggtgcaaaagtaatatgtatttgtgtagaaaccatatagattaaactatgatgttaggtgtattaaatgcattttcagcttataatgggttgatcaggagcaacccattgtaagtcgaggagcatctgtagtctgttgatgattttctttgttttgtagagggaaaaaaatggaaacaagagtgcttgaatgaccaacccaagaccatctagtcagtatatggttgtaggtggtatttgtgtctagaccctctctcccttaatcagttttttttgttgttgttgttactttgmggcccaaatgcaaaagtcatttgggttatcccacattgcactgctggagaccttaactggaaagattgtgtttttattaccaattgctgcatagcaaaacacctcaatggtagtttttgacagggcatgacaggaatgagttatttctgcttcattatatctggggcctcagctgcaaaatttgaatggctgggagatggaatcatccagagacttatcacatgcatggtacctggactgagatgaccagaaggcagaactcatctgagactgttgactggaactctcagatatgccctc

SEQ ID NO: 79957 - DNA, 601 bp, Human
cacatgcatggtacctggactgagatgaccagaaggcagaactcatctgagactgttgactggaactctcagatatgccctctgcatgtgacttgagcttcctcatagcatggtggtctcggtgcaattggatttcttatgtggtgcttcaggattctaaaggagactgttccagtgaagaaggaaaaagctttatggcttttatgactcagtctcagaaatcacatatgatcacttctgccatacccgattggttgaagaagtcacaagcccagccagattcaagaggaagagatagatrccacttcctaatgggaagggtgtgtcaagaatttgaagcctttacttacactcacaagaaactgtttctcttctgactagattgcccaatgtacagtgctatctagaagaaagtaaatgagcaagataatctctagagatctagagagacttgctagcaatgggctctagatttctccatccacatgagaagagaggcctgacagattgttccatttagttctccctggcataccaggtcagagaagaggtgactcttgccatcctttgctgaggataaatactcaaggcatgtgtgtct

SEQ ID NO: 79958 - DNA, 601 bp, Human
tcggtgcaattggatttcttatgtggtgcttcaggattctaaaggagactgttccagtgaagaaggaaaaagctttatggcttttatgactcagtctcagaaatcacatatgatcacttctgccatacccgattggttgaagaagtcacaagcccagccagattcaagaggaagagatagataccacttcctaatgggaagggtgtgtcaagaatttgaagcctttacttacactcacaagaaactgtttctcttctgactagattgcccaatgtacagtgctatctagaagaaagtaaaygagcaagataatctctagagatctagagagacttgctagcaatgggctctagatttctccatccacatgagaagagaggcctgacagattgttccatttagttctccctggcataccaggtcagagaagaggtgactcttgccatcctttgctgaggataaatactcaaggcatgtgtgtcttcatgtaagatgagttacctggcaccaggctaggctaggggcttaagtattatatggcttgaggattccctgactgctgctcgtaagtcataacattgtatcaccttggagggacaat

SEQ ID NO: 79959 - DNA, 601 bp, Human
ctgactagattgcccaatgtacagtgctatctagaagaaagtaaatgagcaagataatctctagagatctagagagacttgctagcaatgggctctagatttctccatccacatgagaagagaggcctgacagattgttccatttagttctccctggcataccaggtcagagaagaggtgactcttgccatcctttgctgaggataaatactcaaggcatgtgtgtcttcatgtaagatgagttacctggcaccaggctaggctaggggcttaagtattatatggcttgaggattccctgmctgctgctcgtaagtcataacattgtatcaccttggagggacaatatttcctctgccacaatccttcagaataaaggtactaagaacctttgtgagtgaggagaagccaaagaaacagattcctgggaattcaaggtactttatccatgagctcaacaggttcctctccttcaagccttaatcaagggatataagcacagggcaagcagggtatcagaccttacaggatcatctttgttgtaccaaaccattgctaacacactggggtctcctgaaacacagattcactatctgctttat

SEQ ID NO: 79960 - DNA, 601 bp, Human
agcaatgggctctagatttctccatccacatgagaagagaggcctgacagattgttccatttagttctccctggcataccaggtcagagaagaggtgactcttgccatcctttgctgaggataaatactcaaggcatgtgtgtcttcatgtaagatgagttacctggcaccaggctaggctaggggcttaagtattatatggcttgaggattccctgactgctgctcgtaagtcataacattgtatcaccttggagggacaatatttcctctgccacaatccttcagaataaaggtactargaacctttgtgagtgaggagaagccaaagaaacagattcctgggaattcaaggtactttatccatgagctcaacaggttcctctccttcaagccttaatcaagggatataagcacagggcaagcagggtatcagaccttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatg

SEQ ID NO: 79961 - DNA, 601 bp, Human
gggaattcaaggtactttatccatgagctcaacaggttcctctccttcaagccttaatcaagggatataagcacagggcaagcagggtatcagaccttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatgctagatttttgtcattagatcatcatgattaactgtacctgyactggtcagcgggggctaggttgtgttgcaataacaaaaactccccaactcttaatgccttaaaacagcacaaatttacctcttcctcatcttgtgtgttcatcaagggtaggcaggtatctgttccatgtcactggtagtcatttggcagaaggaaagggagcactagagggtcttggattggcattaaatggcctggttcagaagtgacacatattacttctatttacaactcactttccagagctaaaattatggtctaatcccacctcaaaatggccaggaagtacagttttacca

SEQ ID NO: 79962 - DNA, 601 bp, Human
cttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatgctagatttttgtcattagatcatcatgattaactgtacctgtactggtcagcgggggctaggttgtgttgcaataacaaaaactccccaactcttaatgccttaaaacagcacaaatttacctcttcctcatcttgygtgttcatcaagggtaggcaggtatctgttccatgtcactggtagtcatttggcagaaggaaagggagcactagagggtcttggattggcattaaatggcctggttcagaagtgacacatattacttctatttacaactcactttccagagctaaaattatggtctaatcccacctcaaaatggccaggaagtacagttttaccatatactggaacacagctagaaaaaaatggcaaattgcattgagtaccacatgacaaccacatgctgtcattctttttttcttcttcacattttta

SEQ ID NO: 79963 - DNA, 601 bp, Human
ttacaggatcatctttgttgtaccaaaccattgctaacacactggggtctcctgaaacacagattcactatctgctttattcttggtagtcaaaggtagccccaaataaccttttatatctcatttcccacatggtgctcctcttaccagcactctgaccatgctagatttttgtcattagatcatcatgattaactgtacctgtactggtcagcgggggctaggttgtgttgcaataacaaaaactccccaactcttaatgccttaaaacagcacaaatttacctcttcctcatcttgtrtgttcatcaagggtaggcaggtatctgttccatgtcactggtagtcatttggcagaaggaaagggagcactagagggtcttggattggcattaaatggcctggttcagaagtgacacatattacttctatttacaactcactttccagagctaaaattatggtctaatcccacctcaaaatggccaggaagtacagttttaccatatactggaacacagctagaaaaaaatggcaaattgcattgagtaccacatgacaaccacatgctgtcattctttttttcttcttcacatttttat

SEQ ID NO: 79964 - DNA, 601 bp, Human
taattttctaagtctaatttaacccacactacagctttgagtggtaggctatattatgccatttacaaatgagtaagtttaacttcacaggggttaagttgctcgttcaatatcatacagctacaaggtggcagaattgagatttaaatttggactttctgagtccaagtccttactcttcaatggctacattacacttatctttaatgctcacgcaatttttttctctaaatcgtagacctggaaacaacaaacagacaaagattatcctctgcagttgtactgtgagggcttagaagayagaaatcatccagtgatttctgatcattggattcctttttgatgaatgaataaaggagggagagaaagagagggaaagaagaaagggagaatagagaaaagcaaagaaggaaaaagaaggaggagtgaaggaggaggagagaggagctgattcttttcacatggaatgcaaatcttgccagtgaggtggtgtgttcctgcgtgagaaggcaggcaaatgcttgtatcctgaggaaaggtgttctgcaaatcgttggcatcactctcataacctgatcatcagctctgtccctcagtctac

SEQ ID NO: 79965 - DNA, 601 bp, Human
atcctggagataatgtgtaagtgcttaattgcatttgctatttagcaattaaccacttgcaggtgcaactagttgtgagcacagttctgcatgtgtgactaattacaggtgtaaaatattcacctcttcagttctcatcatggctcagtggggctcaatgctaattctctcttgccatctgggttcagactcatccgctggccagaggatctcctcaggagaggggtcatgttggggaggcagaggtgctgttttagagcaagaagggaaatggaagtgaaggagagcaggacagagtgcstgagagactgcagggagtcagaagcttagctatgagcatcttccccaccatgctgcctgtgcaaagcagaggactagctgtgttcttggacctccatatcaggacctggcatctccttggttggagccccctgtgaggggtgctggctttctgaaggatctgcagaaggcatctgtctctctccttagaccctttgcataggcagtgacccaaaacctcatagacaggtggttgatggaagtctggacaagtttttagaaagtgtttactctctcagcagtattgccaccatgctgtgtg

SEQ ID NO: 79966 - DNA, 601 bp, Human
gtgacccaaaacctcatagacaggtggttgatggaagtctggacaagtttttagaaagtgtttactctctcagcagtattgccaccatgctgtgtgatggctgcatctttggtccccgcaattcatctgcaaagtaggggtgacaccctcctccaccttcctagtggaactccagggtacctcaagggttaggtgaatgtggacttgcctagtgaagatcaaatgctctgtcctgcaagggatcagggtaactcttgggtggtcatagggagtttctcacttgtaatattttcacagtaaragtcactaaaggggtaaagaggatgaagaagtaggaactagagtagaacccctgaccctgagtttcattcactgtgtctgtgcctctttgcattgccagtggaaagcagaggtctgagaacagctttttgatgatcctcttctgggtgaggatcatcctcttggtggccccacagctgtgggctccactgcagctcggccgtcttccctcaccactgatcccaccacccatgtgaacagtgaccctgagagtagccatctgagagcccctctccacagcttgaagtctggatgggatggg

SEQ ID NO: 79967 - DNA, 601 bp, Human
gctactcttctaggccctagagagggaagggccctcacctgggccccagagagggaagggccctcacctgggccccagagagggaagggccctcacctgggccccagagagggaagggccctcatttgggacccaaggaggtcagagctcccagcctaggaacttgcactgagccatccttgccacattagagggatcacagcagatccaggtatgtgcctccagtgtgtgtgtggtcaggggagtaatggggggaaagccttgaagaggcctagcgaactgagtgcgggggctaggggcragccagagaggagggtgtgaggatgtggcctgaggcaaagggagagatgaggtagcagaggtagagtagttatgtcacagtccacttcatggctggagttagagagcttggtggcatcaaaaaaagagctgtggatgagtgggagaagctgggccagtgtggaccagcaccctgatgtaaggttttccgttgagtactttttattgcacaatggaacttggcttaccagttcctgactcttggtttctgactctggaccactttcagtagactaccctacaagagttggcttgttccctg

SEQ ID NO: 79968 - DNA, 601 bp, Human
tttgagaggtggtgtcagtgttatctgttggctttagatagcagaagcccataattctgagatcagtacagtttaagcctgaatcactggcttattcataatagcaaatgactttggagcctgctgggaaaaccctggtcaggagtcacacatgcagaattccagccaagcagaaaacatgtttgccccagatagtgactgtcagacacagatttcactcccaataacttgggaatgaaacacaaataaggaagtctgcatttcacatgtcttcttagattacaaattcaggcttagcacrttaggtcaggatgtgatagctcagatgccagctcttcagctttattccacaagcaccgggagtgactcttttccagatgattacagaatgtgagtgctggaagaatccctcatgattattccatgaaaccaaatttttcacttgagaaaagtggtgacagggtattcagtgaatttatcaagggtgggccaagtaggggtgctttgtctctgagatggttccttttaagtcattcctgtcaaatgcagcatggcatagacaaggctttcttaattgccattcctcacaaatgagcatgtg

SEQ ID NO: 79969 - DNA, 601 bp, Human
tgagatcagtacagtttaagcctgaatcactggcttattcataatagcaaatgactttggagcctgctgggaaaaccctggtcaggagtcacacatgcagaattccagccaagcagaaaacatgtttgccccagatagtgactgtcagacacagatttcactcccaataacttgggaatgaaacacaaataaggaagtctgcatttcacatgtcttcttagattacaaattcaggcttagcacgttaggtcaggatgtgatagctcagatgccagctcttcagctttattccacaagcacygggagtgactcttttccagatgattacagaatgtgagtgctggaagaatccctcatgattattccatgaaaccaaatttttcacttgagaaaagtggtgacagggtattcagtgaatttatcaagggtgggccaagtaggggtgctttgtctctgagatggttccttttaagtcattcctgtcaaatgcagcatggcatagacaaggctttcttaattgccattcctcacaaatgagcatgtgcattgacatatgtcttgtctgtgtgcgtggcatggaccatcccagccaacatgcggc

SEQ ID NO: 79970 - DNA, 601 bp, Human
gaagtctgcatttcacatgtcttcttagattacaaattcaggcttagcacgttaggtcaggatgtgatagctcagatgccagctcttcagctttattccacaagcaccgggagtgactcttttccagatgattacagaatgtgagtgctggaagaatccctcatgattattccatgaaaccaaatttttcacttgagaaaagtggtgacagggtattcagtgaatttatcaagggtgggccaagtaggggtgctttgtctctgagatggttccttttaagtcattcctgtcaaatgcagcrtggcatagacaaggctttcttaattgccattcctcacaaatgagcatgtgcattgacatatgtcttgtctgtgtgcgtggcatggaccatcccagccaacatgcggctgattccagatgttagcttgaggggccaactcaggttcagcatcagccaaagcacttggaaatacctaagtgatgtcatgatcccatttacgcatctggaggatggaggcctggaacataaaactcttattttccagtccatattggaccttagtctagcctgtgttcttcagactttgcggccaaaaatgtt

SEQ ID NO: 79971 - DNA, 601 bp, Human
ttgcggccaaaaatgttctctaaaatgtcaggttactattataaacttttgatttaaagatattaacacacacacacacacacacacacacacacacatcccaaacaaaaacaagagacctattttccatcactggtgcatcattcattaaaggaaggtcagcttaacaccaacaaaaaattttgtaattgtaatctcagaatttaaacatttaaggattcaatatttatgaaaattattgcaaaaattcaatctttgtgaaaatctcaccacattgcatttagcccttttgtgttaatakagtcttctcacctctgtcagatctgagtatgaaaacaactggactaacctgaatttattaatagaatgaagggcatccctttcttaccttacacaacccatcaagatacttacacagagggaactttgaccatgaaatactgggcactcactattcctcaaatgttagcctatcatgcctaaataatagtaataacagtaacaacaacaacaataataataataattactaacatttattaagcatataatacgtacaggcattgtcttaagtatattgcgtgcgttaatttatctaatc

SEQ ID NO: 79972 - DNA, 601 bp, Human
gagacctattttccatcactggtgcatcattcattaaaggaaggtcagcttaacaccaacaaaaaattttgtaattgtaatctcagaatttaaacatttaaggattcaatatttatgaaaattattgcaaaaattcaatctttgtgaaaatctcaccacattgcatttagcccttttgtgttaatagagtcttctcacctctgtcagatctgagtatgaaaacaactggactaacctgaatttattaatagaatgaagggcatccctttcttaccttacacaacccatcaagatacttacrcagagggaactttgaccatgaaatactgggcactcactattcctcaaatgttagcctatcatgcctaaataatagtaataacagtaacaacaacaacaataataataataattactaacatttattaagcatataatacgtacaggcattgtcttaagtatattgcgtgcgttaatttatctaatcatcacagctgtcatggactgaattacgtccccttaaaattcctgtgttgggccctaaagccctgtagggcctaaggctctaatgtcctctgatggcatttggttataaaacctt

SEQ ID NO: 79973 - DNA, 601 bp, Human
atcagaaaggctctgaatatttgattggaggacaagatagggaggaaagtgaatttactgcaccagagggggaacattacaaatgccttattgaaactgtggagagggagattctgaagatttttgtattcaaggctagcaaatgggaattaactaacatggaaatcattattactataacttatacaaaacgctgttgatattctacttatgtgtgtgtgatgtttttatattagaaaagactttgcttttattaaagttacacatttctattgacatttcaatacacacgcctgcacaygcacgcgcgcgtgccacacacacacacacacacacacatatatgtgaatgactcaaaataatccagaaactactattgttaaatttaggtcaacatcactttagagctgtatctataagctatcttcactgtaactagaaagatggatggcaagtcaaaactaattttagaaagatgtgatcacggtaatctttaacacattaatttaattgtgttaaatgtaaaggaagaaaaataaatgaatataaatggaaggaattgctacatttgataaatgcttcttcaccacaagatatactc

SEQ ID NO: 79974 - DNA, 601 bp, Human
ccctctagaaggactctctcccttccctgagattctagtacattcaggagaacctcagcctatgaatatagctatagagaagtctgaagctaacctatgttttcttttgaggtgatttatttattctatttgctggctgaataattctttctttatctttgaaattcaacaatttcaccaggctatgcctttgcccctgctgattcttccttcattttaagaaatttttttattataagctctctgaatatcttttttgtttgtttgttagtttttgtttttggatagagcctctaacttrgggatgctagtaatcctccatatactattgtgagccgtttctttgttcagaacttattttccatgtattttctccatgttaatagttcagttttaaactctatcaattatttagccatttcttttttatttactagttttatctgtcagtatctgcagagatctgtcagtatctgcagagaatttgtaccaggactcctggggatactggggatctaagtcccttagacaaaatggtataatctgtgctcattctcctgtatattttaaattatctctagattacttgtggtacctacta

SEQ ID NO: 79975 - DNA, 601 bp, Human
atctgcacatgtggaaaccatgaaaacagagggccaactgtattgttactttgatccacaatttgtttcctgaactcggcaatctcccttttatatattattccattatatttggcttttgagcttttgtattattgaattcttttggaagttaaatccttacggataactttcttctatttcttggggtacatttttttccacgtggagctctttttctgtctttttcatgctatgctgctatatttctttcttgttttttctaaggcaattgagaatgaatttgcatatttgccctgcygtttcttttcatttgtgctcacatttaagggcagctctgtacagacctcttgtttgctctaatgtgggctgggtaattcctccttgactctgcccactttgtctgaggttcatttgtctttatacccaagccacagtttaattgcctggatatgtctcctgtctccctttctgtaactgtggaggagggctggaaagtacagatgcatcggtgtacaggctttgatgcactatcactgtcttctctctctcttagactttgttaaatactcgcaaccagggctggtcttccttggtttga

SEQ ID NO: 79976 - DNA, 601 bp, Human
cggtgtacaggctttgatgcactatcactgtcttctctctctcttagactttgttaaatactcgcaaccagggctggtcttccttggtttgaggtagtggtggggtaaagccttggtattcaaattgttttcctgcctcagagtggagatctgcagtttatgtttccatacgggcatcagccctgaaaagaaaaatatttttaaaaataccctctcagcatgctcctttccagccctccagataaaggggtctagaggaatttctcagaactctagctcactagtgctgctgccactggcyccatggacctcaccccttgccccagtgcaaacactctcccctggctgagcacccctactgagggcctgctctttgttccttgcctgccccacattttctttcaacttgaggcctttccaatattgatccctctgcctggattgcacctccctttcttccctcctcattccctaagtcagtctcacctgacccgtcgtgtccccagggagtcttgctgacccctccaatgagacagagtccctgttatttgcatgcacagctctctgctccccatggtaagtattttgctgcttctccagg

SEQ ID NO: 79977 - DNA, 601 bp, Human
ttctctctctcttagactttgttaaatactcgcaaccagggctggtcttccttggtttgaggtagtggtggggtaaagccttggtattcaaattgttttcctgcctcagagtggagatctgcagtttatgtttccatacgggcatcagccctgaaaagaaaaatatttttaaaaataccctctcagcatgctcctttccagccctccagataaaggggtctagaggaatttctcagaactctagctcactagtgctgctgccactggccccatggacctcaccccttgccccagtgcaaayactctcccctggctgagcacccctactgagggcctgctctttgttccttgcctgccccacattttctttcaacttgaggcctttccaatattgatccctctgcctggattgcacctccctttcttccctcctcattccctaagtcagtctcacctgacccgtcgtgtccccagggagtcttgctgacccctccaatgagacagagtccctgttatttgcatgcacagctctctgctccccatggtaagtattttgctgcttctccaggttgtggtgtgtggttacacttttccaggactt

SEQ ID NO: 79978 - DNA, 601 bp, Human
gacgacattgccaagcctccggtcagtatggcaaaggcaagtttgtttcagttcttgtttcctgagaaaaagaggttgaagcaagacaaccatgccacaaatactgagtgagcatctgctacgtgtcaggccctgtcctaagcattttgagcacaagtacaaggtgatccctgcacagcggaagggtctttcctagtgctttggcttccaaggtaaatggcctcaaaatccctggggctcacagccttcaagtgcctgcctaaagggaacagagtgtgtagagtctgaaaggggaggagasggggagccttgttgtcttgtctcaccctctccacactgtgagttccctgagggcaaggcctgtgtcattcacctctctactcacagtgaggcaggaaatggaacaaaatctcacccacttccttattgctgtatttgcttccctgggtgcttgaattccatcccttctgacctaaaccacactgaccccactgtcacagcccctgaatactggatttctaaccctcatttccctccagtgtttgaggctgactgatggactccccactgccagctccaccagccctggcccatcctcatg

SEQ ID NO: 79979 - DNA, 601 bp, Human
ttgatacaattgattgactttagtcagatatcaccagttttacatacacttgtgtgtgtgtgtgtgtgtgtgtgtgtgtgtgtgtgtatttagatctgttcagttttatcacatgtagagttgtatgactaccgccatagtcaagacacagaacagtttcatcacaagcttccctggtgatacccttttatagccatggccagcacctttcctccttcttctccctgatcactgacaatcaatgtgttcttgatctctataattttgtcattacaaggtgctgtataaatggaatcatatrgtatgttaccttcagggatgggcttttttttcactcaacataatctcaacctggatggatctcatttccatacaagttgttgtgaatattaatggtccattccttttattgctgagtagcattctatggtatggatgtactacagattgcttcaccattcatccattgagagacatttgtgttgtttccagttttgggcaattaagaatgaagctgctataacattcatgtacatgtttttttatgtgaacatatattttgttttcatttttctagagatgaccaatgagcatatgaaag

SEQ ID NO: 79980 - DNA, 601 bp, Human
cttcttcctagtatttccaacaatgatcattgtaattcttttgattatttgttagtctgatagctgaaaaacgttaaatcttagttatattaatttggatcttaaaaattgattgccagttggactaaaaaacttatttgtatttcttctatcttgaatgcctgttcatattctttacccatttttctatttagttgcatgaataaacctttgtcatgtatatttcatttcttttgagtgtcataatttgttttaggcctgtagttttttagcaaaatttaacatttttaatgtagtttgrtctatcagtctttttccttatgtgcttttccctttggttccttctttggaagttcctcctcactctaaagttgtataaatggtcatctgtgttttatcatactacttttatggcacaatttttaatttaagtatttaatccagcagggattcatttagggattggatataaagtagggatttagcttgtttcccagtagctaacttgtgtctcagcctcattccttgggaaattgatccttcaccactgattgaaaaggtctcctttgttattgtctatgtttcatcacttctcaggtct

SEQ ID NO: 79981 - DNA, 601 bp, Human
tgtctgcctgtggttcttcattctctctgttttccaaatctttcaccttctgcccaattgttttaatttctttcatatttgctttctacattactgacttgatgttctgaagcttcagtactactctttcctccctgcaaagtggctttgtttctgctataacgtttttagtttccttactattcttccgttttggataaaccttccttttcatctaaacctgcttattttcctctcttgtgactttctctccctctgacttagaggtcatgccttcttgtgcactcctgaaaaagcaaasagtttcctgaatttttcttctcaattctgcagtatctcatttttagaggtatgctcttcctctcacacagtagaatggtgttcccattcctgcagtagctggtattttccctattctattttaagcaaaatggactttgctgagacccagtgaggttttataggcggggttaatagcttattctaggactccatttctgctctctttcagggtgatttaattatcttctcagtttgcaccagctgtggaggagatcaatgtgtgtaggtcttagttcaatttctcatacctgaaatgctt

SEQ ID NO: 79982 - DNA, 601 bp, Human
ctcagaaggcattgcaccatttctagtccttgggtagctatgctgtgtatagatgttttctgggcaaggaagagaatgtaagtcatgaagtgaaaactttcttgactcacaacatagcccagttcctcattggtagtagccctgggtctctaaggcagggcagaagctggactttattacctttttcttcatgcaatctctgttttaggcagtagagttaggatgagcatgtactaagtctggggaggttttctcaaaccatctctgatgcagataccacccattctgacactgggttatwtgtcagtattaaagataggttgttgtgaagtttcaacatttttctgacactataataaatttgctaaaaaatgtgtgaatgctttggggataccatccccattttgagctagaaacttcttaatatattgcgttaaatcatttattcatttatctgtcttttcctccaccatttgtctgtgaggctttgaaagaattataattcaccactacatcaacagtgcctaacacagtgtctcattcataatatttgatagatttttaaaatttatactgggatgagattgccaagggagagaaa

SEQ ID NO: 79983 - DNA, 601 bp, Human
atgtgaggtctgttcagctggctcggagcagacaccttttccatgtatctggcctggaggaggagggtgtcagaggcctttcctgattgagtgctgatcctccttggggcagggtgttcttgcaactttgaagactcactccatggcctctgtctccagcagtgtgaagcatgaacagccaggcgggggagcctgcaccttccatcttgcagctctccaaattacttttctggggaggagaggaagaaaagaagaaatgggggattggaatcaagaggctacaaggcatctgggaggttgytaacagtgagctctgtgtttgaagatggggtggcagtggcgatgtgtccagggcttgcagggataaatgtcggctggtcccctgcctccatctcccagggctgttctatagcctcatggctgtcaaacactcccacctgctgctggacccatgaccacactcaggactttaaaagatcatatgccaatttaaagtattgacaaattttgagaaggtaaaacattcagttcattaaaatatttccaaagggcatatagcaaagccttccctcaccactaaccccaggcccaatggcctccc

SEQ ID NO: 79984 - DNA, 601 bp, Human
tataatctcctggtgcgctgttttttaagcccgtcggaaaagcgcagtattcgggtgggagtgtcccgattttccaggtgccgtccatcacccctttctttgattaggaaagggaactccctgaccccttgtgcttcccgagtgaggcaatgccttgccctgcttcggctcgcgcacggtgcacgcacccactgacctgcgcccactgtctggcactccctagtgagatgaacccagtacctcagatggaaatgcagaaatcacctgtcttctgtgtcgctcaggctgggagctgtagacmggagctgttcctattcggccatcttggctcctccccacatctgatggttttataggcatctggtatttctcctgctcactcttctctctcctgccaacttttgaagaaggtccttgcttccccttcaccttccgccatgattgtaagtttcctgaggcctccccagccatgtggaactgtgagtcaattaaacctctttcctttataaattaaccagtcttaggtatttctgtacagcagtgtaagaacggactaatacaagtactaagtgaaagaagccagacacagaaggacaaatat

SEQ ID NO: 79985 - DNA, 601 bp, Human
tatggggaagaagaggcaaattcatagagacagaaagtagaacagaggttactacgggcagatggggagttattgtttaatgagtacagaatttcgtgttggggatgatgaaaatgttctggatatagatagtggtggtggtgatataatattgtgaatggatttaatgcaactaagttatattcttacaaatggttaaaatgataaatatttagttacagtattttgcaccataaaaatgacaataaaagattgaaatgttttgccaaagcctaagaaagagaatgatgcaaagtagcayatacctgtaatcctagctacttgggaggctgagagaggaagattgcttaaccccaaaagttcaagtgcagtctgggcaacatagtgagacactgtttctaaaaagagagagaatgagaggagaatgctgcagtgaacatccttgtacaatagagtgctctgtaggaatccaaatatatctatacggtacattcccagaaatggggttacaaagtgggaaagtgtatgcattttaaattttgatatatgatgccaagtttttttttttcaaaatattgtgctagataatgctcgaacccat

SEQ ID NO: 79986 - DNA, 601 bp, Human
cctcaactttatcatgtgattcataggaccatggaatagcaccttgaaagaggacctgagggtcccagctgcctaacgcagtagcaattctctagacactcccttacctcccttgcagagcctgggtacacagctaatgacaggaagttcactttttttctgattgttggaaagattgtttcatcaaatgcaccttctggtggtctccagcccctaatcttagactttctgaagaaccagacactcttctgttagtagttcttaggccaattacctgcaaaaataaagcccgaaataatgrcaagtggattcatgaataaatgaatgatgtgcaaactccagtcactgttgttcgtattatcttgtggcttccataacaatacagaactctttggaagggatgtccttaattcagaggatagtgagtgggccttttctgggatgcagactcaccctaggtcatggcaggaagtgcatattcacctgcacacctccatctccttcacatattgtgctgcaaagccaaggctcccgatttataatttacatttgtcctgtataaagagcaccttctcttggcttcaatccagaatttcaatcc

SEQ ID NO: 79987 - DNA, 601 bp, Human
agaattattactaaggggatggccgaggccccagccagccttcacatccgtgacaaaatcatgaggggaggctcaaatgctctgctgaaatcaggacaactgagattgtgggaggaggcaggggacaaaacaggaaagctactattggcgcctgagctctaactaccaaggaagaactagatggttaactagatgggggcatgcagggcaaagcatcagcttggtacatggaacagaaagaagagaggaggctggttgcattcagacacgtagatagaattaaggaataatcataacaaasatatacatagtgcttactatgtgtcctatgcacacttacaatgtgaactcatttgattcccaagcattcctataaggcaaatatcattattatccccattttacagatgaggatgctgaagcacagagaaaggttaaatagtttccctgagtcatgctactggggtttaaacctaaacaggctggctacagagtgtgttcttaagcatttcactctatggccttgaaaagctcagcctccatgatattatcaaatgaatttcaaagaatgcactggcatgttcagccagcacactctttg

SEQ ID NO: 79988 - DNA, 601 bp, Human
cgttgtgctctgaatgtgtaaatggcatttcctagttgagtggaaatggcatggggccatccgagagaagagctggatccagggaaggcttgaccaccacctagcaccttggcctttatttgctccatctttggaaagatgaggctgacccaaggacaacttcagtgtagttattttacttaagaaagagttcagtgtgtcttgagatggaggaacacaactcacatgtctgggtgttagaaagattgagtgcattcagtgcggccaggcccttcactgggcaggtgtggtcacaggggcrtggacttatggatcccatcctactctgttgcagagtcccagggccatgggttgcctggaaggaaaggaacagcataaacccccatccctccttgtctgactgggaggaatatggatgcaggagcagatgtgagggtagtgattagaaaccctggctgcaatgaaagccaccaggaaaggtttgaggccctctgatgcctggcccatctccagagttggattcagttccctctgactcacctgacagcggctgaagtctacaggccccagagccatgaggaggacagggcctgggctttaa

SEQ ID NO: 79989 - DNA, 601 bp, Human
tcttatccactcagctgccattgcctgttcttccactatggtttctttgtcctagaaaagtggttcttaaggtttaaagagtatattaagtgcttgggtattttgttagaataagaattctggtgcagtgagtctgaggtgggccctgagggtctgtatttttttctgtttttttttttttttttttacgcagagtttcactcctgttgcccaggctgcagtgcaatggcacgatcttggctcactgcaacctctgactcccaggttcaagcgattctcctgcctcatcctcgcaggtagstgggactacaggcaagcgccaccacgcctagctaatttttgtatttttagtagagatgggatttcaccatcttggccaggctggtctcgaactccggacctcgtgatccacctacctcggcctccaaaagtgctgggattacaggagtgagccaccgtgcccggccgagggtctgtatttctaacacctgcccccaacctccatgatgtcagtactgctgctgcaagagccacacttggataaacaagttctaacatttttggtttatgttactttttgtttgaccagattcccagattc

SEQ ID NO: 79990 - DNA, 601 bp, Human
gtgtgccttctgctgagggtgctgggggtcgtagccactgaggctgctgctctgcctgcttcatactctgttctggaagtttctttcagccaggaggcagtgaagatgggagtgggggaaacagagacagaaagaacaccctctgagctatcccacaggtccccacacttcccttacaacatgtggctgtcttattactgcagggcctctcaggatgcaacatttgcctttagagaaacccaaatctgggccaaagtctgaggaggtgtgagtctgctttcattgttcttccaaattccastgcattttctactaggtggtttgtaatgccaccatttctttattttcgtgaagattgatttttctcttttttcctatctcctgttttgaagggtgtcaagagaatagggtatagaaaaactgtatcctgacaatgcagtccagattttttttactggataaagcaatactaacttgattttcatattctttccttttggctattccatgccagagagagtctgtcagagtcttctatatacgtaatgagggaccacttgatctggtggcagtgattcaaactgaaggtgccttgtcctga

SEQ ID NO: 79991 - DNA, 601 bp, Human
caaaagggggccttccttttctgtttcttttattcacagttcatttctgttgcttataatcagaaatcctaactgatacaagagtggtgctgagttttgagttatccaggtatttatttagtaggggaaggctgcttctagcaggaagaccatacatactgagtggactgataaatgtttaattttaatgcagcaaattggctattgagtgtgtgctggtggctggcactgtgctaaacactgggaaaacatgtgtccttgtggggctgcagaccagtggaggacacatgcctgcccagcktccaggtcacccttccaaatggatcacattttgaagcctgccttgcctgatgagagcatgtgtcattcatgaagcaatttccctgcaggccttagtggagtcacacagagcaaggccctggcattccacagtgatggcccacctggagctggctttcatgcaggcataaatcaccctctcttttatgagttgttatacttatttcttccagtttttgctttctggttttactttcctttcttcttatttaatagacctcaagagggaaagaatttctggtcacagccaatcacagattaa

SEQ ID NO: 79992 - DNA, 601 bp, Human
ggccttagtggagtcacacagagcaaggccctggcattccacagtgatggcccacctggagctggctttcatgcaggcataaatcaccctctcttttatgagttgttatacttatttcttccagtttttgctttctggttttactttcctttcttcttatttaatagacctcaagagggaaagaatttctggtcacagccaatcacagattaaccccctgtctttaggaacaaaaggaccctgggctgcaggtgtgtgtggaggagagtgggggtgtgttagaaactcccgtgtatggcaycccagcctcacaggacctcacctccacctctggtcctgactccccctgtgcgtggccattccagcaactgccctcttgccttttgctcatggagtctgactacatccttctgtgggccggactgccgctttcatctcccagtgacagtgcttttctcagtgctgtccagttgtccagtgcctggttttttttttttgagatggagttttgctccattgcccaggctggagtgcagtggcatgatctcggctcactgcaacctctacctcctgggttcaagcgattctcctgcctcagcct

SEQ ID NO: 79993 - DNA, 601 bp, Human
aggtggcacagatccagaaaatgctgatcttttaacctggatgaacttgaaaatggcctgggggaggttttaaataaagatggagtgtgtctgtggctgggactgctttagctggatagtctgggaaggcctctttgaagaggtgacacctgagctaaggccagaaaaatgaggagccaaccacacatagagaagtgggaaaggcataccaggaagaggacccagacaggacaaaggccctgaggtgggaagatcttggcagtgtcaaggaccagataggaccatgggctggaagtagcasaggagaagagtggttgagatgaggtctgggaagtagccaggagctagtggcagcagcacagacgttgctctcaactttccttcctgacaagtggagaaagctagccctcctggttggtgcaattataaatgggtaaaggtggggatgagtttggagattgaagggccttcattctgaagtgatcagctgccacgtctactttaatgtcatagtttaagagaatactaaagaagcaaggtttgggtcaccttaaagtacttccagcaacagcctctgttttccaataaaatgcagatatgc

SEQ ID NO: 79994 - DNA, 601 bp, Human
gtggcgtttcctaccagggcctcagccatcacagccaccaaagggagctctgcgtgccccactccacaatacctggaggccccacaccccatacctcagaccccgagcctttagcaccagcacaggaggtggctgcccccacagcagtaggcttgttggctgagcaagattcttccctacctcttccaaaggcctgaaatcccatcacaaagcagtcttatcccccagggataagaatggagcatgtatctggggtcccttaggctggtcaagcagggtggggctttaaaacggcttccaycccaggactctgggggccaaaggggagtcatgtgtgtgcaaagcagacataagcctttaaaggaatagcattgcagttattcatctctgctgtccaaagacttgcctgtagatgaatatttcagaaaaatgacattttcttttctaatcacagaaataaaatatgcctatcgtagaaacatggaagatatgggagatataaagaaaaaatgaaaatcacccagaatgacaccatctgaataatttctaccagccctttgatatattttattttagcattgtgtgtgtatgggatcacatt

SEQ ID NO: 79995 - DNA, 601 bp, Human
gttgtagcatgtctcaatacctcaatttgccattagactttcttatgattttaatagcagcagttttaaatttttatgtattgactgtttcaagctttccctttgtgatctacccctcctattctccgaggttaggtgtcctctagttaaatttacaactatattttctgctaatttttttaaaactactttgttaaaacattaaaataattaaatctcaaggtaatatatggatatagtcctgttgtaagtggctttagtttttacattaattcttcaatctacctggaatgtattttcrtaaatagtaatagggtgagagtctaatttaatttttttttcccaatagtcaattgtcgtagtgtatttctaccccatttgctgctactgcttccttcataatttattaagttcttaaatgtacttgggtctatttcaagtcttctctgttacagtgccttgtttatctatgattgtaccagtgttgtattttctaattctaacagttgtaaactaagctacatcctggttagacaagtcacctctcttattgtttttacagtctttcttaattcctttgcctattcattttaccagaaga

SEQ ID NO: 79996 - DNA, 601 bp, Human
taattaaatctcaaggtaatatatggatatagtcctgttgtaagtggctttagtttttacattaattcttcaatctacctggaatgtattttcgtaaatagtaatagggtgagagtctaatttaatttttttttcccaatagtcaattgtcgtagtgtatttctaccccatttgctgctactgcttccttcataatttattaagttcttaaatgtacttgggtctatttcaagtcttctctgttacagtgccttgtttatctatgattgtaccagtgttgtattttctaattctaacagtygtaaactaagctacatcctggttagacaagtcacctctcttattgtttttacagtctttcttaattcctttgcctattcattttaccagaagatcttagaattattttgtcacatctatctgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaatttttt

SEQ ID NO: 79997 - DNA, 601 bp, Human
agaagatcttagaattattttgtcacatctatctgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaaytggttatttctggtattaaagaaatctctccccccaccccccaccggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataa

SEQ ID NO: 79998 - DNA, 601 bp, Human
ctgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctccycccaccccccaccggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctagga

SEQ ID NO: 79999 - DNA, 601 bp, Human
tgtcttctttttaaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctcccyccaccccccaccggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctaggaa

SEQ ID NO: 80000 - DNA, 601 bp, Human
aaccatgcattttccccaccagtaaacagctgccaataattttatttgttgtgttttttaaataatacattaatttgggaattgattgtattcagtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctccccccaccccccacyggtttacttttctcaacactcttttctaattataagatattttctggttgtttcctttgcaatttctatgtctttaatcatactgtccaaagcaatgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctaggaagaaaataacaca

SEQ ID NO: 80001 - DNA, 601 bp, Human
gtcttccatctggtaacatatgtttcatattgtcaaatcttattttatatattttattatgtttttaattttttctatttctgtgccacaatttagggccttcccgatgtctttgattgcttttgattttttttattgctattgtgagtggatttctaaaactggttatttctggtattaaagaaatctctccccccaccccccaccggtttacttttctcaacactcttttctaattataagatattttctggttgtttcctttgcaatttctatgtctttaatcatactgtccaaagcratgattattttttcttcctttttaatagttacatctctaatttctgtttcatttcttattgccctggtctgatctttgaaaagtgtaaagcattagtgaaggggaataagattatttctctctaattttaatgggactgccttttgttgtttcatcaataagaattgtgtaggtttaaagtagaatgctaggaagaaaataacacatattaacttgaaagaatagtaaagaagaatatatatgtttggaaataaggatattgttttccttgttgatcaactgacatgaaattttgattac

SEQ ID NO: 80002 - DNA, 601 bp, Human
ttctgttcttgcctttgtgagatgacgggaggctagtccttcattggttatctggtttcttcttttactttttctcctgcctgaattcttgttgatttttaaaagtccttttggacaaatatgagagctttcaaacataatgtattaagatgtattaagttgtttctgtgtgtatgtttgtatgtgtatgttaacaagagtatgagattaatatgttcagtatgatgagaaacaggcactcttactgccttaaaatacatctcccatggagtacagcagtttttctcatcctctgcattastgaaattttggtctgaataattctttgttgtggggagctgtcctgtgcattgtagaagatttagcaggatccttggcctctattcattagatgccagtagcaccccctctcctcaagttgtgacagccaaaatatctccagaaattgttaaatatttcctggggttgggggttggtgccagaatcgccccctgttgagaatcagtgcaatagaaggtggcctgacttgtatttttttatttagaacttaggggcagaaatagatcatttccactattttatttcaagtttgctctgtttc

SEQ ID NO: 80003 - DNA, 601 bp, Human
gcaaagaagtgtgagactcagttgaagcatggtgtgaaaacagtttggctgcataccctttgcccaacttcatctcaagagactcgggaaaaatatagaaacacctcctttccatattgtttattttcatgtcacaaactgttgggtggaatgaaaacagggctctagtgttgctctagttgtgaaaatacaacttttacttcttctgttttaatcccagagaggggaagttccaactaatctgctaaagccaccttctttaaaacctttcaaccacgtggtttagaaacacggatggacrtcgccagaatttaaaagtgtgctagttcccagccagagcagagcacgtgtctgggggctcccttttcatctggtctccatccatcctacaccggggggttgtctagcacctttttccttcctgttgtagtgggcccactttggaaatggcagcttttcatttcgtaaattaatttctatttttattaaagtaatggattaaacaattccatgagtaccaaaaggaaaaaatcagtttcctgatcatctcccctaccccattcttttccctaacacttcctatctgtttcttagatatact

SEQ ID NO: 80004 - DNA, 601 bp, Human
atattgtttattttcatgtcacaaactgttgggtggaatgaaaacagggctctagtgttgctctagttgtgaaaatacaacttttacttcttctgttttaatcccagagaggggaagttccaactaatctgctaaagccaccttctttaaaacctttcaaccacgtggtttagaaacacggatggacatcgccagaatttaaaagtgtgctagttcccagccagagcagagcacgtgtctgggggctcccttttcatctggtctccatccatcctacaccggggggttgtctagcaccttyttccttcctgttgtagtgggcccactttggaaatggcagcttttcatttcgtaaattaatttctatttttattaaagtaatggattaaacaattccatgagtaccaaaaggaaaaaatcagtttcctgatcatctcccctaccccattcttttccctaacacttcctatctgtttcttagatatactcccattttttgaattatatgcttaatgtgctttattgatgtcaatttagacattgtcttttgacttccctttatcaatgctgaggatttggatctcttgcccctttctatatt

SEQ ID NO: 80005 - DNA, 601 bp, Human
ttgtgaaaatacaacttttacttcttctgttttaatcccagagaggggaagttccaactaatctgctaaagccaccttctttaaaacctttcaaccacgtggtttagaaacacggatggacatcgccagaatttaaaagtgtgctagttcccagccagagcagagcacgtgtctgggggctcccttttcatctggtctccatccatcctacaccggggggttgtctagcacctttttccttcctgttgtagtgggcccactttggaaatggcagcttttcatttcgtaaattaatttctayttttattaaagtaatggattaaacaattccatgagtaccaaaaggaaaaaatcagtttcctgatcatctcccctaccccattcttttccctaacacttcctatctgtttcttagatatactcccattttttgaattatatgcttaatgtgctttattgatgtcaatttagacattgtcttttgacttccctttatcaatgctgaggatttggatctcttgcccctttctatatttttcttcttctcttattttgctaatatctattactatatgtattatatatccatgtggtaattata

SEQ ID NO: 80006 - DNA, 601 bp, Human
cgccattttttaagcccgtcggaaaagcgcagtattcgggtgggtgtgaccctattctccaggtgccgtccatcacccctttctttgattaggaaagggaactccctgaccccttgcgcttcccgagtcaggcaatgcctcgccctgctttggctcgtgcacggtgcgcgcacccactgacctgcgcccactgtctggcactccctagtgagatgaaccccgtacctcagatggaaatgcagaaatcacctgtcttctgtgtcgtcaggctgagagctgtagactggagctgttcctattyggccctcttggctcctccctcaagaaggttacaaagaatcccttctctcttttcttccttctctctctctctttctccctttctctctttctctgtttcttgatggggtctcactctgtagccttgtctggagtgtagtggcctggtctcagctcactgcaacttctgcctcctgggctcaaataatcctcctgcctcagcatccagcgtagctgtgactggaggtatacaccaccatgcctggcgaatttttgtatattttgtagaggcagggtttctccacattgtccatgctggtct

SEQ ID NO: 80007 - DNA, 601 bp, Human
ccctagtgagatgaaccccgtacctcagatggaaatgcagaaatcacctgtcttctgtgtcgtcaggctgagagctgtagactggagctgttcctattcggccctcttggctcctccctcaagaaggttacaaagaatcccttctctcttttcttccttctctctctctctttctccctttctctctttctctgtttcttgatggggtctcactctgtagccttgtctggagtgtagtggcctggtctcagctcactgcaacttctgcctcctgggctcaaataatcctcctgcctcagcmtccagcgtagctgtgactggaggtatacaccaccatgcctggcgaatttttgtatattttgtagaggcagggtttctccacattgtccatgctggtcttgaactcctgggctcaagtgatctgcctgcctggatctcccaaattgccggggttataggcatgagccactgcatccagctgcaactatttttcaatgcttagccaagtagagttacattgttattttctttttcttgtacttttttccacaaagccaatcaaaattctataataataacaaatattattttccaaatgctc

SEQ ID NO: 80008 - DNA, 601 bp, Human
gtacctcagatggaaatgcagaaatcacctgtcttctgtgtcgtcaggctgagagctgtagactggagctgttcctattcggccctcttggctcctccctcaagaaggttacaaagaatcccttctctcttttcttccttctctctctctctttctccctttctctctttctctgtttcttgatggggtctcactctgtagccttgtctggagtgtagtggcctggtctcagctcactgcaacttctgcctcctgggctcaaataatcctcctgcctcagcatccagcgtagctgtgactrgaggtatacaccaccatgcctggcgaatttttgtatattttgtagaggcagggtttctccacattgtccatgctggtcttgaactcctgggctcaagtgatctgcctgcctggatctcccaaattgccggggttataggcatgagccactgcatccagctgcaactatttttcaatgcttagccaagtagagttacattgttattttctttttcttgtacttttttccacaaagccaatcaaaattctataataataacaaatattattttccaaatgctcagatagttcagatgatctc

SEQ ID NO: 80009 - DNA, 601 bp, Human
gtagccttgtctggagtgtagtggcctggtctcagctcactgcaacttctgcctcctgggctcaaataatcctcctgcctcagcatccagcgtagctgtgactggaggtatacaccaccatgcctggcgaatttttgtatattttgtagaggcagggtttctccacattgtccatgctggtcttgaactcctgggctcaagtgatctgcctgcctggatctcccaaattgccggggttataggcatgagccactgcatccagctgcaactatttttcaatgcttagccaagtagagttacrttgttattttctttttcttgtacttttttccacaaagccaatcaaaattctataataataacaaatattattttccaaatgctcagatagttcagatgatctcccaactccttcctcaagtcctctcttcaaaagtatgcttgaaaggtaaatgttttgtatcctcacttctctgaaaatacaattatcctacccttatatttcgttgattggctgggtatgatgtctaagttaaaaatcatttttcctccaaaatttgaatacattgatttggcttcttctgcttgtcagtgctgctgt

SEQ ID NO: 80010 - DNA, 601 bp, Human
tgtcagtgctgctgttgggaaagccagtgacatttcaattttccttattttgtttttgggtttggtttgattttcttcgttggaagcattcaagttcttctcttttatccctgaaattctgaaatttcatgtttcttctttttctaatactcattgcctgggtactgcacagatatttcagtctggagtttgatgtctttttatctgataaaatttattctagtgctttttggataacttctatccattttaccagttatctttctcaaacttttgttagtaagatatgagacttctcagwtggattcttttatttttttttttaaatctcttttttctatctctgattttttttttctttttttaggtcatttctcctacttcatcataaaactattttattgatttgtttttatattagcttttatttttatttcctaagacatttattttcatagcatcctgttttactttcatgagtgcaatattgttccatctctctgaggatatttattctagttttagacattttcttcaattatctgctttgcttctttttcttctgaatcctctgtttgtaggttttgttacctcagactga

SEQ ID NO: 80011 - DNA, 601 bp, Human
ttttgtttttgggtttggtttgattttcttcgttggaagcattcaagttcttctcttttatccctgaaattctgaaatttcatgtttcttctttttctaatactcattgcctgggtactgcacagatatttcagtctggagtttgatgtctttttatctgataaaatttattctagtgctttttggataacttctatccattttaccagttatctttctcaaacttttgttagtaagatatgagacttctcagatggattcttttatttttttttttaaatctcttttttctatctctgattttttttttctttttttaggtcatttctcctacttcatcataaaactattttattgatttgtttttatattagcttttatttttatttcctaagacatttattttcatagcatcctgttttactttcatgagtgcaatattgttccatctctctgaggatatttattctagttttagacattttcttcaattatctgctttgcttctttttcttctgaatcctctgtttgtaggttttgttacctcagactgagggcttaaaaaattgtatctgagcacccaggccatctcttcatattt

SEQ ID NO: 80012 - DNA, 601 bp, Human
actcattgcctgggtactgcacagatatttcagtctggagtttgatgtctttttatctgataaaatttattctagtgctttttggataacttctatccattttaccagttatctttctcaaacttttgttagtaagatatgagacttctcagatggattcttttatttttttttttaaatctcttttttctatctctgattttttttttctttttttaggtcatttctcctacttcatcataaaactattttattgatttgtttttatattagcttttatttttatttcctaagacatttwttttcatagcatcctgttttactttcatgagtgcaatattgttccatctctctgaggatatttattctagttttagacattttcttcaattatctgctttgcttctttttcttctgaatcctctgtttgtaggttttgttacctcagactgagggcttaaaaaattgtatctgagcacccaggccatctcttcatattttagtgtgaggcactgaaaggtgatcagcagctctatgtgagtggcgggggctgattgatgaatgggtgccattgttgggtggtgagatggcaagatgatca

SEQ ID NO: 80013 - DNA, 601 bp, Human
caggaccctcctgctcatcagcacagtccctctcatactcattttcatgggtctggcatctgtttctgggaaatgctggacagctggagacctactgtccactggccttgaggtactactccagcatctcctgccactgcacatatacttgcatgatgcattagtcatataccattccatagcatatgagcttgtggcagggtcaggtgactggcccatgtggagggctgtctgtaacatgccagcactgctataccaccaaaaagacaagtttggtccatagggtagttggctcatgggatttgccgaagcatctggtctagccaggtccccaggtttgaagaaaagaggggcataagtgtatggaaatcctctttggagctaacattcatttatctatctctccattcatttttccttccatccactcgtctctccatccattcactatttccacatacatccacttagtactctccagtggctgccaggctttagtctaaatactgaggacagagaggtaagaagccgcttctgaccccaggagcctatggttgggtgggaagacagaggaggccgttggcataggtagcacagcaag

SEQ ID NO: 80014 - DNA, 601 bp, Human
agtgtatggaaatcctctttggagctaacattcatttatctatctctccattcatttttccttccatccactcgtctctccatccattcactatttccacatacatccacttagtactctccagtggctgccaggctttagtctaaatactgaggacagagaggtaagaagccgcttctgaccccaggagcctatggttgggtgggaagacagaggaggccgttggcataggtagcacagcaaggccgttgagacgctatctctggaggactagagcctcaggcccatatcataactactsggggagggtgatgccagagaggactgaggccagtgcaaccaagcagctgggggttgcttgaattggacagggagaaaatcaatcagggaagtggtggaattggcatatacccatccaaaccggtcaggatggaggaggcaggcctgcatggcctgtgaggtcagctgacccctcactgttttcccattctgtgttgtctttgccatgtgggtgctctgcagtgtataggctactgtgccctgagactgagagagatgggtacctgcaggcttgcacagttcaagtgttgctgtcttctac

SEQ ID NO: 80015 - DNA, 601 bp, Human
tcagccaccatgaaagtgtgactgatgggtgtcctggccttcatcttcttctgaaccgttgtataagcatgggataggttccttaacctctgtgatcagtcaggtcctatgtctatttaggatatttctagaatatctagcagctaggtcagctaggtccacaggcagctaggtcaggaaacccaaatatggaagctgcatcttgatctgtggacggtagcactggactgatgtgactgggtttcagggctgcagaggtttacaaaagtgagcagtggggcttgatgagcagtcctgatgkggctattaggacagctttctgctctcctgattgattgattcgggcagccaagtgtcaggccaagtgggcaggaccagagcaatggggtggtaaatagactaccgagaagatagatggattgttgttctttaatcaggcattctctcaagacatggggaacatcttgacctgggatatcgccaccctcatcccaggcccagtaatgagagaattagcacatgctgaagagctagagtaactgctcaggcttggaagcaaaatagagggttttctgtgcagcaaatcactttgaaactaaat

SEQ ID NO: 80016 - DNA, 601 bp, Human
gggctgcagaggtttacaaaagtgagcagtggggcttgatgagcagtcctgatgtggctattaggacagctttctgctctcctgattgattgattcgggcagccaagtgtcaggccaagtgggcaggaccagagcaatggggtggtaaatagactaccgagaagatagatggattgttgttctttaatcaggcattctctcaagacatggggaacatcttgacctgggatatcgccaccctcatcccaggcccagtaatgagagaattagcacatgctgaagagctagagtaactgctcakgcttggaagcaaaatagagggttttctgtgcagcaaatcactttgaaactaaatctccttactccagatgcactctgaaaatgaaaagtctgttctttgtttcaaatctccaagagacaggaagaatactgggatcagactgtggcctctggggaggatttgatagaatgctccctggtcttggccttgaaaactggaggaggttcaaatcctcagggagacgtcccttgaggacaaatgctttgtacaggaaagcactcgttagatatgtactggagaaaatgactggttttgcatgaa

SEQ ID NO: 80017 - DNA, 601 bp, Human
cgcccatcagtgatgctttctgtataatgatagaaaaggagtaaatgaaccagctaaaagtttgcactgtatctcagattcactttggataaaagtcttattactgaacaagccaagaggtacaagattgaaatgtggattttacatttcctggaggtttcatgatttctgcattgagtgggtacaattaatctatgttctttgagtggtgaattttattaaaccaggttttctctgcctcctcagacactgactggttaaatgacttataaaataaacttgcaggaattctgcagttagwgttagaattggtgtgccccatattaggctctacccttttcttatcacagtcattgtttacctaccagatctcccaacctaagagccgcaggaacatgtgggcttatcacagagctcgggtgtgtccccttcctgcaagtatgcttctcccactatcctcaccagagtaaggtgtgaggggcaagttagccatttgtagctccagtgaacagtccaagctccactggggtagcctccctaagtcctgcttatataacatgtgtgagtttacttttcacccgtggtggggtaggaatgacag

SEQ ID NO: 80018 - DNA, 601 bp, Human
ctggggtagcctccctaagtcctgcttatataacatgtgtgagtttacttttcacccgtggtggggtaggaatgacagaaaattctttgacacatatccaaagaagagatggtgcccatttctcctccctttgaatctgggctgggctgtgattattttgactaatggactgtggcaaaagtaacactttacccgttccgagtcttgcctttaacagcatgtgctgcttcctctttggtcagttcgtgccctgagtaaacatgtaagtcctgctcctctgcaagaggggagtacatagagwatccctgaaacttcagggagagagagataggcccagtctggcagctgaccctgtcaaggtgccaggctgctgagttggaccattttggctccttgaggccccctatgtccggaattggtgggttcttggtctcactgacttcaagaatgaagccgcggaccctcgcggtgagtgttacagctcttaaggtggcgcgtctggagtctgtcccttctgatattcagatgtgttcggagtttcttccttctggtgggttcgtggtctcgctggctcaggagtgaagctgcagaccttcgcggt

SEQ ID NO: 80019 - DNA, 601 bp, Human
acagagagcacacaaaagaggggattgaactcctgctttcatttatttattttctgagacagggtctcactctgtcacctagggtggagtacagtggcatgaccatggctcactgcagccccgatctcctgggcagtcctcccacctcagccacctgagtagctgagactacaggcctgcaccactatgccagctaattttttaaatatctttttgtagagatgaagttttgccatattgcccaggctggactcgaactcttggactcaaatgatccaactgcctcagcttctcaaagtgytggtgctatggtatgagccaccatacccggcctcatctttttatagggaacccacttctgtgataatatccttaatctgttcatgagggcagagcccttatagcctaatcacctctcatttggccccacttctcaacactgttacattgggaattacatttctaaaatatgcttttcaggagacacatgcaaaccatagcagtctcaaatggatttttcacaaagaacagtattttagtgtaagtatgacccacaaaatatttaggacatacatatatgagtatatgaaaaaaaaattca

SEQ ID NO: 80020 - DNA, 601 bp, Human
tgcccctcctgcagtgctggtggtctgggtcttgcttattgagctgagtttgttgagtttgcaaggcagccttcactgggctgattgtttcctcttgaaaaattcacttgcactgaggttggtgactctaggtaggtaaggtgctgccttattatctggtctgtccaaacagcaagctcattatccaactgatcacaggaaaattctcgtgactcatactctaagacctcttcctaaaacatgtatgtatttatttattttttattttttattttttttgagacagagtctccgtctgtcrcccaggctggagtgcagtggcgcaatctcggctcactgcaacctccacctcccaggttcaagtgattcttgtgcctcagtctcccgagtagctgggactacaggcatacgccaccatacctcgctaattttttgtatttttagtagagacaagtttcgccacattgctatggctagtcttgaactcctgagctcaagcaatccacctgcctcagattcccaaagagctgagatgacaggtgtgagccattgtgcctggctcttaaagtatttaaacagctccctatatcaaactgcaaat

SEQ ID NO: 80021 - DNA, 601 bp, Human
catgctttcctggcagggagtggctctgcctacatctgccctgagggaccagtccctgtgggtaaaggccagtatccagccctcagcaagcagagcaatttcagctcttctttgcagcacattgtgtgctgctgactagtgtgctgcaaagaagagaggttaagaacaccagcttcatggtcagccagaaccagttcataatcccaattctgcttacttatttttgactgtttaatacggagcccactgcttcacctctttaggtcttagtttcctggccttaaatggaggcaaaattatrcttgtttcatagggttgttggaaagattaaacaagataccataggcaaaggtctcagcacaatgtctattcttgagcaaatgcttaataaatgacactgattgttcttagaaaatatattaactaggtctttaatatcctaacatatttggttgtttttaaagcggtgtcttaaaagctaaaataagctgcctactcatttcgagtacatgtgagtattcctagctgatgcattatagtatagaaatgttttttccaattttttttcttccatagttttaccttttgtattttctttgtt

SEQ ID NO: 80022 - DNA, 601 bp, Human
acaacagtccaatgaactcaaaaaaggccctgatggagggagagagaggaaaagaagtgacagcttacagagaggtcaagagaggagaaatgctgggcaaattagagcaagtaacctttgcagatggcagctggggaaacagaaggtgagaaactgtcattccaaattgcaactttcacaaggagaatgaatcagtaccttggcagacaggtgcctgagtttcccagtgtcatactctccagcctggcttctcagaggacccattcccgtgaccctgttaaaggtccattggcatctgcargtcttcttgttaattggaaaagcatcgaactgcacagccagcaaaagcccattgaggattcagggcctctgcaggactgactgacctattaactgcttccctgcctgcagctctcagctttatgtactcagaggtccccgaggctgtgtgctttctctgtagtgcattgattctctcattcatctactccgtttattcattcattcactcattcatttctctgtttatttgtttcttcccttaacaaacatttacttacacccttgtgacagtttctttttactgtaggccagtgcttct

SEQ ID NO: 80023 - DNA, 601 bp, Human
ccatagatgaaagatggacatttgtgggttacaaagggattgaataggcaatggagagagcagatattgaccacactggcaagatgggcagtgaagagctagagacagtggagtgatggctcaaaaaggaagcacagggaaactgaagggtgctctaagagtcagtggagggcaagggtggaggtgctgggaaggaggagggaagggaatcctcccttagtcccttttctgtctgagtctctttcaagtcttaaaaaaaatactctttttttttttttctttttctttctttcttttttctttttttttttttttttttttttgagatagggtctcactcttccaggctggagtgcagtggcaccatcaccaacatcatggcttactgcagcctcgacctcctgggcttgggtgattctcccacctcagcctccccagtagctgggactatgggtgtgtgccaccatgcctgcctgttttttgtaattttactagacatggggtttcagcatattgcccaggctggtcttgaacttctggcctcaagcagtctgcctgcctaggcctcccaaagtgctgggattacaggcatgagtcattg

SEQ ID NO: 80024 - DNA, 601 bp, Human
tgagttggtttctatgtgaggacacaggtgacgaaaccaggcctcctgtccatgaggaacgcacagcttgtggactaacttctggacctgtgaagtctgtgctctgagtgtttttcctgttggaaacatgagatagggcaaaagctggctggtccctgatgttgctctcctttatgcttccagtggtaccccgggaccctgaggagccccaccctgggcatggtgcctgcctcctcttacctttttgtcttcacagccaaggcattttatttgaagtttaaggtcatgtgcagtttgtttyctgttgctggcatccaaattgatataaatcattgactaaaggcaagttagaggaaatgatatagagatacattcaagacagcatgtatacatgactaatatggatggccgattgaggggatcttctaggattagattacacatgattttgctttatttgatgactttagatcctaaccttttgagttagacgtgactctcttgaaaatgtaatgaccacctacagccactgttattctgtaaaagtcaccttgatccccatgccccaaatggtaaggacataatgtacagcatagttctt

SEQ ID NO: 80025 - DNA, 601 bp, Human
acttaaagcaagacaaaggcaccaaggtgattatttcctaataataaatcccccaaactgcttcctatcactctattaataacttattccttgaaggtttcctctctgaaatttaggaatggctcaagcaagctgtcatccttctaaatggtttctgatcatagcttcaagattgattagtaactgctctcctatttctccccacctggaggcatctttgagagcaacatgctgaaaagatgacaacagcaggacctaaggaattcataaatggctttgactgcgtgggttttgatgaggyaatatggaaaatgattgcattaagtattgctatttatttacttgactttgtacaggacaatcaattttttcacgttccatgcctcctgtcaggaagttaaacggcagagaaggcagactggaggcattacctcatttctctaagagatgctgtcactcctcaaatcaccttagaatgttgttaataacagcatctttcattcctatccactgagggagtagagattctcccttcacaaagaaaggacactgaggaaggcgagatatgaccaggaaaagatgagctaattttttcatgaac

SEQ ID NO: 80026 - DNA, 601 bp, Human
cttagaatgttgttaataacagcatctttcattcctatccactgagggagtagagattctcccttcacaaagaaaggacactgaggaaggcgagatatgaccaggaaaagatgagctaattttttcatgaactatataaaaatctacttctgtaggtcaattattggcaattttatataggtaacccaataatgtaacacatgactttgtcagtataatgttaatctgtcctaggaaagcaagatttggctctatttgagcatttagagaaaaaattccagacccttgtagagaaagctgrtcaatgtttagccttggtcagagcagatatcaaactggagttatataaagagatatgggtcagaggctgaactggacccattgaatgaacttgatggaacagtgaatgcatttctggtgtgtgtcgattgaatattttggggaattctggaaaattgatcagaatgattgatggctcctttaagatggtctcttgagtttgaatatcaagctctggaaatcaggctcctgggttagaagaaaaggctggttagagaaagagaaaaaggaaacaatgtttgctttttatttaagaggtgaa

SEQ ID NO: 80027 - DNA, 601 bp, Human
ctcactacccctcccagcctctggtaaccatccttctactctctatgtccatgagttcaattgttttgtttttagatccccaaataaatgagaatatgtgatatttgtctttctgtttctggcttatctcacttaacataatgatctccagttccatccaagttgttgcaaatgattggatctcatttaaaaaaaaatttccgtaggttattggagtacaggtggtgtttggttacatgagaaagttcttcagtggtgatttgtgagattttggtgcacccatcacctgagcagtatacayggcatcctatttgtagccttttatctcttgtcccctcccacctttacccacaagtccccaaagtccgttgtatcattcttatgcttttgtgtcctcatagcttagctcccacttaggaatgaccaccccccccccgacccaagtccccaaagtccattgcatcattcttatgcttttgcatcctcatggcttagctcccacttatgagtgagaacatacaatgtttggttttccattcctgagttacttcgcgtagaataatagtctccagtctcatctaggtcactacgaatgctgtta

SEQ ID NO: 80028 - DNA, 601 bp, Human
tagtatccaaaggaggaaagactaggtgctggatacaagaagcagtttcaaagtatgagcctttaagcaggttgattggatatctgaactatccccaaccagccctgggcttccttttcagtcatctctaccacctgtcaatgttgcgctttctggaggctgaaacaaccttgccagctgccctgcccatctgagaattcagacatctagagtgccagagtctgctggcatctcccttttgtcaactgcagggttagattgcctgggaatcgatagccagaatccatgagccatctgatgwgtagacctgctgctgagctgttgtctgcatatcaccctccaattacagggcccccatttccccgtctgtttcatcatgcaacccaagcacccaggtagaaggccttttgacctgttgctcccatggacctgctgaggtatcttaagatgatgaaatgtctctttcttctgcctcccacactagctgccaacagctaggagctgatgggctttgtgcttcttcaggaataagggcttggctgatgatagggtgtggtggcttatatggcatcatccacagctcttctcagtccctaggtgg

SEQ ID NO: 80029 - DNA, 601 bp, Human
cagaatccatgagccatctgatgagtagacctgctgctgagctgttgtctgcatatcaccctccaattacagggcccccatttccccgtctgtttcatcatgcaacccaagcacccaggtagaaggccttttgacctgttgctcccatggacctgctgaggtatcttaagatgatgaaatgtctctttcttctgcctcccacactagctgccaacagctaggagctgatgggctttgtgcttcttcaggaataagggcttggctgatgatagggtgtggtggcttatatggcatcatccasagctcttctcagtccctaggtggtagaaagaaagaagcagctggcaggaggctactatcctgcctccactccatcagactcacagttcttcttaatcactgccattgctaattcttactgagtgtggacagtggacaggccactctatgaaggaggagagatgctctttacctgcaaggggcttgcctgatggagagtcccagaaaatgtcttggcacctgtaggtaacgttagccctttctcctatttgaggcagttggggatggatgagtagatggtcagtcacatcagtggttggaa

SEQ ID NO: 80030 - DNA, 601 bp, Human
ggatttcagcaaagaagatacacaaatgatttttatacacatgaaaatatgcccaacatcattagtcagtaaggaaatgcaaattaaaaacacaatgatatactactttacactcactagaatggatataattttaaattcaaaaatggaagtcttatacaatactgctgggaatgtaaaattgtacagctgctttggaaaacagtttggcagtttcttaagttaattataagtttaccatatgacccagcaattccactcctcagatttttactcaagagaatgaaaacatatgtccatraagtgacttgcatgcagatattcacagcagcattattcataatagccaaaaggtggaaaccatccaaatgtttatcaactggtgaatggataaacaaaatgtggtatatccatacaatggaatattgttcatcagtaaaaaggaatgaaatactgacacacattacactatggatgaatgccaaaacattgtgctaagttattgaagccagatttttgaaaatgttgaatgagtcctagaaatgtccagaaatgacaaatccacagaaacagaaagtagataagtggttgcctagaatta

SEQ ID NO: 80031 - DNA, 601 bp, Human
tgttctccccttccctgcctcccttcaccccagctatctccattctctaatgcatgggggcaactggagtgttgagtagacatggccatcccaagtccattttctgtgtccagcggggtacctggaacttaggagtgcccctggctggacgaagaggtgtgacagtgcatctctgtagcaagtgcactgttttaacagagatcctgtttgtttgaggtggctttagtcaataatgagggatgggctaatgttccacacttcttgggattgtcactgtagcaacgctgcctccctggcctgygcacttctccctagctgttacttgtaagattgggaaagggagaaaggggagagaggaatctcctggggaagcgaggtattcctgcaaagcctggtccaggtgtgatgcactctgcagggcaaaatcatgggctcagaatgaggcttcacagaggaggtagagtgtgcccaagggcaagatttcagaagggaaaaagtagggccagagagaagggggaggggtgcaggaggagaaattctgccccaaaccaaaactcttatggttaaggacaaggttaatcagattcttttgaaagggaat

SEQ ID NO: 80032 - DNA, 601 bp, Human
cccattgctgtcttctgcaacattctgggccactggctttaataataatgacccttatctgtgcagccacgagcagacctggcctagggctcacctgtgttctccaatggctgagttagttgattaacacaaagaggcaatgagagcaaccctgactttgaggaattcctaaagggaagctaagcgtgtcttcccaagtgtattacctggtctcagaagtttatagccacaccacataaactggtgcagtgagacatttggctgttctcttggaagagacatcaagagtcatttagaactsctgcatgcaggtttctggtcggtgtcaacacatggaaagcttctggagggctgaagcctttaatgagtggttgcttccttctcccaactggaatcacccaccttggagcccaggtttactgctctgagattgtaaagatgccaaggaatggagacagcctggttttttattgtgcctgcctcagatggaatctgcctctctggacaaagatagcatcacaaatgtttgatgcgggtgtctcttcttgtcctgaggacccgggcctctcagcattgcccagtgttcctcagcacacacaaa

SEQ ID NO: 80033 - DNA, 601 bp, Human
agaagaaagaagcttcctactaactccctttccacagaagggcctctttgcatttctgttgttctactccacacaaaagagatatgagaggatgcagacagatatgtggggggtggtaggagggcatccatgttagggttaggaagtccgggcagccccttccaggaccgagctgccttaagaatccagaatcagccaggcccaacaggatccttaatgacctctgacggtgggatggaggaggaccagaagagtgaggaattggtaggcacacctcaagagaaactcagaagtgggggtrggggagggtgttcctgaaacatgtccatgctccctacttatttcaagactcagttcgacatcgtgccccacttcaagacttcccagcttatttggaacactcagtctctctcctcacaaacacaaagtcttctgcttgattaggttggtgatgggtatatgacaatgacactagcaagctgctaaacatccttgactctttccaccaccatgcctttatgcatgacattttctcaccctggggtgcctaccttcattttgcctacctagtaaactatgaatgcttcaaagcctgcatcag

SEQ ID NO: 80034 - DNA, 601 bp, Human
tcaggtgctcaaaaggagggtgtcctccctattccagaacctgcaagccccacttctctttccaaagtctgcatcagagttggtgaggtcctgagcaaaagtcgcaggtcagacaaaatgaattctgccaaatctctctgccttcagccttttggataaatctcatgcatatattctgccttgtcatagtaactcttacttggagaatcttttggaatgactataaccttatttcaatattggttattactcatggttgtttcactttttaagaattgactctagacttgcaaagtgctayatccactatcactgcaatttaggagctgagctctgactgaacaaacccccctggcaacattgtggcagagccagttagacctgactgattcctccatgaccttggacaggccactttcctctaaataatctgcttagggaggtccatgcccatgtctgcagtgccacactgggcagacaggcaaggacagggcagtgtagggggaagggtttctgccccttatctgtcaagacagctctgataatttaggctgagaatttcagcctcaaagcttttgctctgccattaaaagaagtaaaa

SEQ ID NO: 80035 - DNA, 601 bp, Human
catttatttctcacagttctgaatactaggaagtccaagatcaatgtgccagaagatccagggtctggtgagggcccacttcctggtttgcagatgaccatctgctcattgtacacttacagggcagaaagaaagctctctcgtatttcttcttattaggccattaatcccatttatgagggctccaccctcgtgacttaattactccacagagtcctcacctccaagtagtatcatattcggggccaggcacaatggctcatgcctgtagtgccagcactttgggaggccaaggggggcrgatcacgaggtcgggagatcgagaccatcctggctaacacggtgaaaccccgtctctacttaaaaaacaaaagttagccaggtgtggtgacacatgcctgtagtcccagctactttggaggctgaggcaggagtatcgcttgaaccctggaggtggaggttgcagtgagctgagatcatgccactgcactccagcctgggccacagagcaagactctgtctacaaaaaaaaaaaaaaaaaaagaaaaaaaattacattcggaattaggcttcaacgtatgatttttttttctttgttttt

SEQ ID NO: 80036 - DNA, 601 bp, Human
aatactaggaagtccaagatcaatgtgccagaagatccagggtctggtgagggcccacttcctggtttgcagatgaccatctgctcattgtacacttacagggcagaaagaaagctctctcgtatttcttcttattaggccattaatcccatttatgagggctccaccctcgtgacttaattactccacagagtcctcacctccaagtagtatcatattcggggccaggcacaatggctcatgcctgtagtgccagcactttgggaggccaaggggggcggatcacgaggtcgggagatcragaccatcctggctaacacggtgaaaccccgtctctacttaaaaaacaaaagttagccaggtgtggtgacacatgcctgtagtcccagctactttggaggctgaggcaggagtatcgcttgaaccctggaggtggaggttgcagtgagctgagatcatgccactgcactccagcctgggccacagagcaagactctgtctacaaaaaaaaaaaaaaaaaaagaaaaaaaattacattcggaattaggcttcaacgtatgatttttttttctttgttttttttttttttttttttgagggg

SEQ ID NO: 80037 - DNA, 601 bp, Human
cattcatcaacttcagcaagtgtcatcatgagtgatacaagtgtatgacacagctaagtgtctcctctgcacaggccattacagctggcagcaggcccagggaggcaagaactggagactcatttggctccaagtgcccaggatgatgtagaagtaaatgcgctccagccctcctcccaccatggcccacatagatgcttcgtattcttggcaccttctacaactactctcaaagtttccccaggtaagctagggatggtcttggtgcaatcttttccctttgcctcatcctcccatcctycctctgtgccaacttttacacatcctttgaggccctgtgcacgaaccacctcctctaggcagccttccaacggcaacccactctccccttcctctaaagacctctgtcacagagcatctccacctctgctgtagaaattttattggtaaacacttcaccctgacctgctatgctcagctcagctccttggaattggaggttgtcattcatatttttgtgtcctctgcaagatttttaaatgtactggatgagaatttctttgattactaaagtcatgtatatgtaatacaaaacattgat

SEQ ID NO: 80038 - DNA, 601 bp, Human
tgtcatcatgagtgatacaagtgtatgacacagctaagtgtctcctctgcacaggccattacagctggcagcaggcccagggaggcaagaactggagactcatttggctccaagtgcccaggatgatgtagaagtaaatgcgctccagccctcctcccaccatggcccacatagatgcttcgtattcttggcaccttctacaactactctcaaagtttccccaggtaagctagggatggtcttggtgcaatcttttccctttgcctcatcctcccatcctccctctgtgccaacttttacmcatcctttgaggccctgtgcacgaaccacctcctctaggcagccttccaacggcaacccactctccccttcctctaaagacctctgtcacagagcatctccacctctgctgtagaaattttattggtaaacacttcaccctgacctgctatgctcagctcagctccttggaattggaggttgtcattcatatttttgtgtcctctgcaagatttttaaatgtactggatgagaatttctttgattactaaagtcatgtatatgtaatacaaaacattgataaagtacagaaacataataa

SEQ ID NO: 80039 - DNA, 601 bp, Human
acccactctccccttcctctaaagacctctgtcacagagcatctccacctctgctgtagaaattttattggtaaacacttcaccctgacctgctatgctcagctcagctccttggaattggaggttgtcattcatatttttgtgtcctctgcaagatttttaaatgtactggatgagaatttctttgattactaaagtcatgtatatgtaatacaaaacattgataaagtacagaaacataataataatgtcaccattcccagattttattttccattttgctgagtatgatatgtttgartgtgtgtgtgtgtgtgtgtataaaatgaagttcatagtctcatactctatagttttagaccacacttttataatatttttccaagtcacaattttaactgctgtgcaatattccattatatgaatgttgcatgatttatttagtcaataccttatcatcagacttttaagttcctccctctccctttctctcttctttctttcttccctattataaataacactgtgatgaacatcaatgaacataaatcttttcccacacctgcttgctttttttttctagaataagtttttagaaata

SEQ ID NO: 80040 - DNA, 601 bp, Human
agaacaagcctggccaacacggtaaaaccccgtctgtactaaaaatacaaaaattagttaggtggtagtggcgctttcctgtaatccctgctactcgggaggctgaggcaggagaattgcttgaccctgggaggcggaggttgcggtgagcagagatcacgccactgcactccagtctgggcaacagagtgagaccctgcctcaaaaaaaaaaaaaaaaaaaaaaaaaagggaatccacactttgtgtgggagtgctcattatctcacattctctaatattaatatcatatttgttgttgttattattatcatcacagcttttatcttttgtgtcttatcacagcagtccttcagtgaacactcactcaattagccgtagaatgtgtatgcctatgtgtaagtttgtgctaagcgctggggaaagggaaatacaaagatggcaacacctattatccatcttcagagagctttcaaactagtacattggatggatggatggatggatggacggatggatggatggatggatggatggaagaatggacagatggatgggtgcttgggaaatatttccttgccatcagttttctcaacacattg

SEQ ID NO: 80041 - DNA, 601 bp, Human
cccattctgggaaagcaaagactgcttttgagaatagacagaggaatcccagtgcagaaacctcatgccacttccttctagggagtttcaccaggcctgaaatttcagagctgggaacctatttgttcagccaccagtaatgtgaaagtaatggagacatttggccacagaagtgactttaaatagtggcccaatgtggggccacaggacctatggaaggagctatgcagagctgtttgcatgacccacaggaatttcttgcccaccaacaccacacctatcacacaattcttagcagctkctgagagaggcttttctgcctctcttacagaatgagaacaaagcgtaagataaaggaaggggaggttgtaggagcaatgaactctgggctgcgaacctccttcttcctggccagaagcatgtaccttgcctctctcccagttgccccatgaggcaggctgacttccctgagccagctgctgagctgcacctgccttgagaaaaaggcacccagttcttaagcaggggatgaatattcattggcatgaacctttgcaaactcatttggggaaaaaaatagatcagaagaagtaatcagatt

SEQ ID NO: 80042 - DNA, 601 bp, Human
agaaaaaggcacccagttcttaagcaggggatgaatattcattggcatgaacctttgcaaactcatttggggaaaaaaatagatcagaagaagtaatcagattattaaaaagaaagagcaaggacagaaggtggcagtggagggaagaatcacatttaaaatgcaaggagagacttcctccctgcggtgtagctctgaccccctagaccatgcgctgagaatagttaagctctcccacatttatgctgcataaaaatgttgtttttgaggcctcatctgagagggggaagggcagaggtarcacgcaccctccacatctgaaaattataaaataatattttgaggtctccattttatcttcctttgatatcaagaaaaattgtgagagctaaagaggctctggtgagtgctgagtgacaggttaaagggctccaataaagattagatggtccactatctcctgaggaaattgcataaaagtggttattccctcttgcttctattaatttcctcttcctggctgcttggaaatgctttgtaacctgatgctgcagatggggatgagaagcgctttccattatctcaatcactgcactgttta

SEQ ID NO: 80043 - DNA, 601 bp, Human
acatctgaaaattataaaataatattttgaggtctccattttatcttcctttgatatcaagaaaaattgtgagagctaaagaggctctggtgagtgctgagtgacaggttaaagggctccaataaagattagatggtccactatctcctgaggaaattgcataaaagtggttattccctcttgcttctattaatttcctcttcctggctgcttggaaatgctttgtaacctgatgctgcagatggggatgagaagcgctttccattatctcaatcactgcactgtttatgagacacttaayctgtttctttataaagtaatagtactgtgggtgatggactcagtgtcactggaagtctgtgtgcagggacaggaggagaggagtgtctcgagagtatggtaagcagaaggtcatttgtcatatcactgaggtgctgagaagttgggtgggtgtttcaaggtgaccttctggataccagccagaggtgacatgcacctatcccttggcacttgaacagggaggcaaatgtgtgttttgtctgttgaatggaaaatatatacacgtttaggcatggggtgctcagatcttgtctcctcccct

SEQ ID NO: 80044 - DNA, 601 bp, Human
aagtctgtgtgcagggacaggaggagaggagtgtctcgagagtatggtaagcagaaggtcatttgtcatatcactgaggtgctgagaagttgggtgggtgtttcaaggtgaccttctggataccagccagaggtgacatgcacctatcccttggcacttgaacagggaggcaaatgtgtgttttgtctgttgaatggaaaatatatacacgtttaggcatggggtgctcagatcttgtctcctccccttttctgaagttgggggtggggaaagagatgtgtggtgaggtcggggagagggrtgccatcaaaaagcctcggctatgcaagtttctaggccttctgtctgaactgcaatcacttacaatggaggaaagggaacccctttctcttaaggaaacaaggcaattgtaggctgcactggtgttagaaatgtccagccctccaagttaccttgtcccattgacaaaggtcttaatgcgaatacacagcaaggtgtcggcggctcttctctttctacccacctcctggaaatgtaatggaactctcccctgcaaagtccaaagctgggcactttatgacccaatttccgttcctacttc

SEQ ID NO: 80045 - DNA, 601 bp, Human
tagcataagtgtggttacaaattacaagctaaaaggttaataaatgaactcaggaatactacttcttttataaagtttcttgtgactctcatcttataaggagactctgcaaaaggtgtacatccatccacctggtcccctgtgtgcacacaagcatagcacagatcctgctgtatcagaagcagcattccattgtccacctccctcaccaggaagggagcttcctaatgttggctaccccatctgcaccctgctctattcccctagcctggtgcctggctagaagtcaatccacaataartatttgttgaatgaggggctcccaactgcagcagtagtgctgaccgtaattctgtaaaggaactcctgagttttgaaatgatacgaaagcagagaactctgttatttaccttaagttgcctgaaagtgctgaaatgtgtttggttaggctaccgctgtatttaattattattgtttaaaattgtacagtctttatgcaggtgagcagtctccaggctgccagggtctccaccactctgcactgtgtgactcccggctgctttatattctcaagtgactgacctggctccaaaggccattt

SEQ ID NO: 80046 - DNA, 601 bp, Human
tctattcccctagcctggtgcctggctagaagtcaatccacaataaatatttgttgaatgaggggctcccaactgcagcagtagtgctgaccgtaattctgtaaaggaactcctgagttttgaaatgatacgaaagcagagaactctgttatttaccttaagttgcctgaaagtgctgaaatgtgtttggttaggctaccgctgtatttaattattattgtttaaaattgtacagtctttatgcaggtgagcagtctccaggctgccagggtctccaccactctgcactgtgtgactcccrgctgctttatattctcaagtgactgacctggctccaaaggccatttgcttttgcttctcatggcctgaatattcttcatcagaagccacccagaagctttatttatcaccccaagttaaagctgctttttctcaagtgacagcatagttttcttatttatttttctatgttaaatttctagtgaaaaaatattgttaacttttgtttctgattaatggcacctgatacaagataagttaaaagggctttgtggattagcctggcactttcacccttgttttaagcatgaattctatgaga

SEQ ID NO: 80047 - DNA, 601 bp, Human
gtctccaccactctgcactgtgtgactcccggctgctttatattctcaagtgactgacctggctccaaaggccatttgcttttgcttctcatggcctgaatattcttcatcagaagccacccagaagctttatttatcaccccaagttaaagctgctttttctcaagtgacagcatagttttcttatttatttttctatgttaaatttctagtgaaaaaatattgttaacttttgtttctgattaatggcacctgatacaagataagttaaaagggctttgtggattagcctggcactttmacccttgttttaagcatgaattctatgagaaagtatagcacaacaatgtaaaagtttaataaattactgagcatatacccaaaagattataaatcattctactataaagacacatgcacacgtatgtttattgtagcactatttacaatagcaaagacttggaaccaacccaaatgcccatcaatgatagactggataaagaaaagtggcacatatacaccatggaataccttgcagccataaaaagaatgagttcatgccctttgcagggacatggatgaagctggaaaccatcattct

SEQ ID NO: 80048 - DNA, 601 bp, Human
aaatcattctactataaagacacatgcacacgtatgtttattgtagcactatttacaatagcaaagacttggaaccaacccaaatgcccatcaatgatagactggataaagaaaagtggcacatatacaccatggaataccttgcagccataaaaagaatgagttcatgccctttgcagggacatggatgaagctggaaaccatcattctcagcaaactaacacagaaacagaaaaccaaacaacatatgttctcactcataagtaggagttgaacaatgagaacacatggacacagggargggaacatcacaccctggggcctgttggggggtgggggcaaggggaaggatagcattaggacaaatacctaatgcatgcagggcttaaaacctagatgatgggttgataggtgcagcaaaccacaatggcacatgtatccctatgtaacaaacctgcacgttctgcacatgtatcccacaacttaaagtaaaaaaaagaaaaaagaaaaaaaaatctttaataaatgaatttaggaatgctgcttcttatataaattaaggcatgcctagacagattttatgaaagtattaagttataaa

SEQ ID NO: 80049 - DNA, 601 bp, Human
tctactataaagacacatgcacacgtatgtttattgtagcactatttacaatagcaaagacttggaaccaacccaaatgcccatcaatgatagactggataaagaaaagtggcacatatacaccatggaataccttgcagccataaaaagaatgagttcatgccctttgcagggacatggatgaagctggaaaccatcattctcagcaaactaacacagaaacagaaaaccaaacaacatatgttctcactcataagtaggagttgaacaatgagaacacatggacacagggaggggaacrtcacaccctggggcctgttggggggtgggggcaaggggaaggatagcattaggacaaatacctaatgcatgcagggcttaaaacctagatgatgggttgataggtgcagcaaaccacaatggcacatgtatccctatgtaacaaacctgcacgttctgcacatgtatcccacaacttaaagtaaaaaaaagaaaaaagaaaaaaaaatctttaataaatgaatttaggaatgctgcttcttatataaattaaggcatgcctagacagattttatgaaagtattaagttataaagtctgag

SEQ ID NO: 80050 - DNA, 601 bp, Human
tcctcatgtgtgctgcaacatggcattgaaaaaccgtgggtccaacatgtcattgaaaaacctgggacccctttctaactgaggccataggatgagatgtctttagtgagtggctcagggaaaggccatggatgttaaccaggtagacagaagagggagtaaccatttatagagcacttatgtcccaggaactgagctacactttagatttgttttctcaattaaatctcttgacacacctggaagggaagaattattatccattttgttcaagtgagagaggtcattggtaccaagaagwtatatttcacaaaggatttttgaagaattggaagtgttaaatatgggtttcctcaaccttagatctcccttggtacgagaggggcatctcaatgttctttttagagaggaagacactccttttccggttgtagggaagagtttctggctgccacacttccattaattatcacatggtctctttgtgttctagcttgccctgcagggacattcaaggccagccaggaagctgaaggctgctcccactgcccctccaacagccgctcccctgcagaggcgtctcccatctgcacctgtcgga

SEQ ID NO: 80051 - DNA, 601 bp, Human
actccttttccggttgtagggaagagtttctggctgccacacttccattaattatcacatggtctctttgtgttctagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagtaagtgtctagtaatggctctgggctggggagtttggttccctgatggtgcaagtggtgggtctgsggcaaggaagagaagacatcatcctttgatcccagggcaaagcagaattgctggccatggtgctgaaacatacaactcctatgctcggagttcagaggccttgtccctacgtagcactgggtgaagattacattttttctttcttcccccttcttcccatataagaggaccttctcccaccccagcaagataacttctgttcatcagatgtcagactggagagttctttggatgcaaaatcatgatctattatcacttcctccaagaagtccctcctggtgcctatagctgagaatctcc

SEQ ID NO: 80052 - DNA, 601 bp, Human
tttgggagtcagtgctccaggttagcctctaatgtgttagaattttcttcttcattggataatgcttcctggctccctgtgagcagggacctttctttacacctgcttggaccaaatcccttccatccatccccatcacagaagaatatttcatttatactttctgtttgatgaacagaaaaagtgactggactcttagtagaagaattacttaattccagccttgtagtgtatgtaacctttactgagtaaagagggggaatgaaagtaccttctagatcaagttcctgagttcaatcartgtgtatagatttgaactgaggaaaagctcatcctgttgtaaactgattttctacagacctctctctctgtgggttaatattaacaaaaatgattgtttctgctgaccagaagtcctgtttttctgttgtgctatctcctccactgatttctgaggttgccctgggggtcttcaataagcccaaaaagcattgtttaatgtacttctttagaaatcacttaaggatgctgaatcactgctccctggatgttcagaccaaagactagtctccatgattgccgaagtatatgcccagggact

SEQ ID NO: 80053 - DNA, 601 bp, Human
gaccaaatcccttccatccatccccatcacagaagaatatttcatttatactttctgtttgatgaacagaaaaagtgactggactcttagtagaagaattacttaattccagccttgtagtgtatgtaacctttactgagtaaagagggggaatgaaagtaccttctagatcaagttcctgagttcaatcaatgtgtatagatttgaactgaggaaaagctcatcctgttgtaaactgattttctacagacctctctctctgtgggttaatattaacaaaaatgattgtttctgctgaccrgaagtcctgtttttctgttgtgctatctcctccactgatttctgaggttgccctgggggtcttcaataagcccaaaaagcattgtttaatgtacttctttagaaatcacttaaggatgctgaatcactgctccctggatgttcagaccaaagactagtctccatgattgccgaagtatatgcccagggactcacagtattcctcctgaaaacgctcctttccattccttctcattaacccctcaggtgcacctggaagtctggaggggcctcaggtttagtgtgcagccgttgactttaa

SEQ ID NO: 80054 - DNA, 601 bp, Human
ccttcctccctgtagtgctccctgaggcactgcccagaagccctcagtttacctggtgaatcctggcatccccaaactgcctcagtcttgagtgggttctgggaaagctcatagaatcattgatttcatttagtgggtggaagatgggctttggcacttcagagacaaaagtttcaaacttgattctgtctcttgccttctctgtgaccttggtctaaatccttggtctaagctttcttacattctgtcattttattctcacgacttcataataatgtatgcttttctgagttattatgargattcagccaaatagtattgtagagtccttggcacagtgcctggttcatagtaaactctcaatcgatgttagaacttgctttggttacatccctggaaagtgtgaagattgcagcagatattgaagcttccagcatgagaggatgttggatatctgaaaataaaagtgatgttgttgggggagcccaggcttgacgccatcaccgagcatcacagcagaatccatgatatggtcccaaaccacacagtcgccttggcctaaagaacctgctgaaaacaaatgagaaggtgactgccctac

SEQ ID NO: 80055 - DNA, 601 bp, Human
tcctccctcctgactgccactgagaggcagggaagcttagtggcaggggcaggggttttgagtttggctcctgacggtaagacctggggcaagttacttagccttttggaacacgagcttccttctggataaaattgggtatgctggaactcaaattacgaggttgtgagaattaaaagccagcaagcaaatgaagctccaggatgaaaactcaggtctgtctgactctaattccatgacctcagtgatgttgcaaaccatcgtggcgatgatggtgattggctgttattctcactcatgratctaccttgcttagagaaggataagaatctgctcttccttctcccattcctgcatagtctggtttctctcctttaagttcatgtttcatcttttaaggtgctggcagttgtttccctcttttatcccaggcacgacagggcagtggtggggtgggggggtggtgtccctgtggcataaggatcatgtcccttggacagactgcccaggagtgggacattcccagggcctagaccctgatcttcccagggaagcagggtggatggagaagagtgcatagggtttagagggtagaaatggc

SEQ ID NO: 80056 - DNA, 601 bp, Human
cctgtggcataaggatcatgtcccttggacagactgcccaggagtgggacattcccagggcctagaccctgatcttcccagggaagcagggtggatggagaagagtgcatagggtttagagggtagaaatggctttggtatgacagaaacagaatgacgtcctctgcaggtggcctctgcagccaggtttggtggccatagagcattgtgggtctgtaaggacatgagcttataagccctctggtcttgggcacaggatctgctgcatcatgctcaataagatccccactgatggtttccyttaggtcagtggttttaaaatgcagtccctggacaagcagcctccgtgtcacctaggaacttactaaaattaaaaattctcagccccaacccggagccactgaatgagaagctctggaggtggagcccagtgatcagagttttaacaagccctgcaagtaactctgaaggctgtgaaagtttggaaacattgctttagagttgggtcatattcctctgtcctttgctttatgacttctgaggagaaaggccattgggtgaattctcacagactggaaccacagggccttcccctccccat

SEQ ID NO: 80057 - DNA, 601 bp, Human
cccagggcctagaccctgatcttcccagggaagcagggtggatggagaagagtgcatagggtttagagggtagaaatggctttggtatgacagaaacagaatgacgtcctctgcaggtggcctctgcagccaggtttggtggccatagagcattgtgggtctgtaaggacatgagcttataagccctctggtcttgggcacaggatctgctgcatcatgctcaataagatccccactgatggtttcctttaggtcagtggttttaaaatgcagtccctggacaagcagcctccgtgtcacytaggaacttactaaaattaaaaattctcagccccaacccggagccactgaatgagaagctctggaggtggagcccagtgatcagagttttaacaagccctgcaagtaactctgaaggctgtgaaagtttggaaacattgctttagagttgggtcatattcctctgtcctttgctttatgacttctgaggagaaaggccattgggtgaattctcacagactggaaccacagggccttcccctccccatcaatgtcctgtgtgccaggctagaaagctgcagggaggggggctgtgaatatg

SEQ ID NO: 80058 - DNA, 601 bp, Human
tgggtcatattcctctgtcctttgctttatgacttctgaggagaaaggccattgggtgaattctcacagactggaaccacagggccttcccctccccatcaatgtcctgtgtgccaggctagaaagctgcagggaggggggctgtgaatatgtatgtgagagagaggaggggtggggtctgatgtgagtgtgaatgtacgagcgcatctgtgtttatttgagtggttcaagggagggtctcactacttctcagaataatccccacctgttctggctcaatttctatttcattttcactctytttttttgagatggagtctcactctgtcacccaggctggactgcagtggcgtgatctcagctcgctgcaacctccacctcccaggttcaagcgattctcctgcctcagcctcccgagtagctgggattacaggtgctcgccaccagacccggctaatttttgtatttttagtagagatggggtttcaccatgttggtcaggctggtctcgaactcctgaccttgtgatctgcccgcctcagcctcccaaagtgctgggattataggcgtgagccaccgcgcccagcccattttcactctt

SEQ ID NO: 80059 - DNA, 601 bp, Human
tcacacctgtaatcccagcactttgggaggccaaggcaggcaaatcatgaggtcaggagttcgagaccagcctggccaatatggtgaaaccctgtctctactaaaaaaaaaaaaaaaaaaaaaaaaaaaaaaaatccaaaaattagccgggcgtggtggcatgttcctgtagtcccagctactcggaggctgaggcagaagaattgcttgaacctgggaggcagaggttgcagtgagccaagatcgtgtcactgcactccagcctggatgatagagcaagactctgtctcagatagataaataaataaataaataaataaataaataaataaataaataaaacaatatttggcatacaggaataattcaataaaagtaagctatttgattttattactattatcagagttgtctaccctactttgatgtaattttcaaagcagctaaaatccaagcacaggcactattatttagttaacatttcttccttcaatatacaagtatttgtatacttttagaagttactcttgtggaaatctaggtttactctatactctatactctttttcttcacaggctaataaatttttagagaaagaaa

SEQ ID NO: 80060 - DNA, 601 bp, Human
ttctgagaagctttccccacaattggctggaaaattccaagtctgagccagacacctgagaactgctatgatatgggattggctgtgggcttaaaatctggactttccaatgtataaataatcactgatgattttgaagacacagagcagtctgcagtctgaagtcaacctatagaaggcttatgattccctctaccctgtgccagagactacctccaccccattaaataaaaagtgttctggctctgaagccacatcaagaagggtggcttgtcttcaagaggctgaaggatagagaacyagaggctagttgaacactaaggtcaatctgtccccccttcccattctggagactagtaggttgtggcaatggtactaataggaatggtgtgctggcccctccttggctgtgtcttagacttgcaggagatgcccaaggtggccttttaagcaactcctctgagtcacctcagaggtttgcctttccaggcttaccttggaaatggcaatgaagggtgctcagttgtgcaggttggagtgaacttgcatggcagctgtgtagtgagatgaagccaggtgcaggctgtctcttctggggcag

SEQ ID NO: 80061 - DNA, 601 bp, Human
actacctccaccccattaaataaaaagtgttctggctctgaagccacatcaagaagggtggcttgtcttcaagaggctgaaggatagagaactagaggctagttgaacactaaggtcaatctgtccccccttcccattctggagactagtaggttgtggcaatggtactaataggaatggtgtgctggcccctccttggctgtgtcttagacttgcaggagatgcccaaggtggccttttaagcaactcctctgagtcacctcagaggtttgcctttccaggcttaccttggaaatggcartgaagggtgctcagttgtgcaggttggagtgaacttgcatggcagctgtgtagtgagatgaagccaggtgcaggctgtctcttctggggcagaggtgcccagaaggtgagggctggggtggggtggggggcaatggtcagtgggaacccatggtcactgccatgccctgccagtactccatgagcaataatggaaagccactcagttctcacaaagagattgtcatctactggtcagcaaaggggaactgagcaccaggtaagaattggctctccctgtaagtgaaaggcaggctttgtg

SEQ ID NO: 80062 - DNA, 601 bp, Human
gtccagtgcatctttcctcactgtagaaagcttttgatgctgcatttcaggggtatgaaaggggtcttgaaagccatgtctttaagatgacatgacctatagttcttgacttggagcatttccaggggattttcaggggtggcagcatattgtacctttccactctttggccccaccttgagccacagctagaagattcaaccttctatccatctcccgcatggatagtaacctgagactagtcataaatacctccctactgaggtgcactgcctcccaggatccaggggcctcagccatyctctaagggcttctgcagcctcaaggaaacctagactctcagacttgagctcaggctaggtagaggggctgtctcttttcccagaatgtataatctacttcctttcttccagacaattggctccattgaagcaggagaaacaataagtactttctacaaacactggttttggtaaaatgtgtagcactaggctctttgatgctcctgaaatccctctcagcagggtccctccttgttttgactaatcatttcttcttattactaactgttatgattaggagaattgcctgagtacaggcc

SEQ ID NO: 80063 - DNA, 601 bp, Human
ttcaggggtggcagcatattgtacctttccactctttggccccaccttgagccacagctagaagattcaaccttctatccatctcccgcatggatagtaacctgagactagtcataaatacctccctactgaggtgcactgcctcccaggatccaggggcctcagccattctctaagggcttctgcagcctcaaggaaacctagactctcagacttgagctcaggctaggtagaggggctgtctcttttcccagaatgtataatctacttcctttcttccagacaattggctccattgaascaggagaaacaataagtactttctacaaacactggttttggtaaaatgtgtagcactaggctctttgatgctcctgaaatccctctcagcagggtccctccttgttttgactaatcatttcttcttattactaactgttatgattaggagaattgcctgagtacaggcccagtgtttccaagaccctaatgagcaacacgtgcagactcgcttagcatagtcctggaatcatggttgttctgtttcctcagggaagctgctgagatgcctcagggacaggagctttttcctgcctctgtg

SEQ ID NO: 80064 - DNA, 601 bp, Human
acacgtgcagactcgcttagcatagtcctggaatcatggttgttctgtttcctcagggaagctgctgagatgcctcagggacaggagctttttcctgcctctgtgaaatctttccccagcccccagaaaatgctttgcatcacagctgtgttgtacagcattaggtgcctctaccccaggtggaagagttgttaaggatgagatttggaacctgccagccctgcactcaagtcttggttccaccagtgcatgagttgggcaagtttctttatactctgagctagagttttctcatgattamactgtagacaatagttcctacttcaaagagtgttggaaagataagattacattaagtaatccacaaaatacctaagacagtactttgcatacagtatttatcaataaaagaaaattcaaatttccatgttgacctccactgctttcagatgcacctagtatccaaaagttcaatttctctttcttggttccaaagacaattcaagggcaagtagaaatctgctccagggaaaggacccaaaattggtcatttgggcagtgatatgaacaagtttcatcaagtcagagccatgtccacagg

SEQ ID NO: 80065 - DNA, 601 bp, Human
gaaccaagtacattcccacctcagggcctttgcacatgccggtcctttgggctggggaacactccctctagatatttgcattgcttctgtctcatcacactcaggtctctgtccagatggcctctgctctgagagagctcccctcaccacaccagcatgctgtctcccctcctccttctctgtgtatcatcagagccctatgactgctgatactattcatttatctacgtattgaaatgttttctgactccttcactagagaataagctccatgagggcagtgtctgtgtcactgtcttcrcattcatcattaccatataacaatgagttaaaaattacagctgccaatagagaagccatcctaagtgactggcactgttctaaacctttacttacactgctcaattggtagtccattacaacactcctatgggttgctgtgatcatcatgcagattttaccagtgaatatgctgaggcttagataggctatgccaaaatccagaattcaactcagttctgtctgtatctgaagatctgtgacctcccatccttagtaatttgctactggggttcatttaaagctgatttcaaaggtggta

SEQ ID NO: 80066 - DNA, 601 bp, Human
ctgataatacctaggagtcttgagtatcaagtgtccttcctggcttattcccagaccccactgcaattctttcacctaaagagagaaagaaaagagggcacagtttgctgtgggagtaaaggaaaggtttcctttcccataggtcaggggaggacaatgaataccagataccaagtcaaagtcaggctacctctagggaggccaggaagcagagatacaggtacagacagaagtcacaagcccagtacctaataagaactggacccattctggagacacagccccatgctcaaggctaagkttctgccccttggtagaagtgcttgctggggctaggtggccaggaaggtgcagattggggcaggcagactccaaggtgtttctgtgacaggtaccagagatcatctctgaatctattgatttgcactggtcatgtcttttcccaagcatctgtaacaccttgcatctgtaccactttgatcctttactgtatgtgttcacagtttccagcactccttaggtatgggctcctacatcaggtttccccaacataggttccatgacctcacggctttcacagtctttagcataattctgaatg

SEQ ID NO: 80067 - DNA, 601 bp, Human
ccactgtggttgccaccttcaccatcacccaatggggagggatcccaggacacagaccctggcttcagcaatgcacaatgagctagacccgacctgcttggcaccttgtaccagcctgaaatttactactaaattctgagaccagaaggttagccttattaagattcctgataaaggaattggctttgggggcttacctgtcttcagcagattttcactttgattactcaggagtgctcttatttccagcttaatgcctgcaaataaactcacccgctctctcccacacaccctgtctcaccattctttaaaaaatcatctggcccaaatcacattaagaagcaggagattctatcttaatatggtagcacttgggctggccctgtgggtctagaaggatcctgtttaactccagtgacaaccgtgctccatgcaggctaagccaacctctcaggcacatcctggaggacatcggagacccatcttcaaaactcatgaccaaccacactccctcctcacccaaacagaaaatcacagctcaacacttctcccatcctttaaaaggactgaatttccttagccctttaaacagaatgcattc

SEQ ID NO: 80068 - DNA, 601 bp, Human
attctgagaccagaaggttagccttattaagattcctgataaaggaattggctttgggggcttacctgtcttcagcagattttcactttgattactcaggagtgctcttatttccagcttaatgcctgcaaataaactcacccgctctctcccacacaccctgtctcaccattctttaaaaaatcatctggcccaaatcacattaagaagcaggagattctatcttaatatggtagcacttgggctggccctgtgggtctagaaggatcctgtttaactccagtgacaaccgtgctccatkcaggctaagccaacctctcaggcacatcctggaggacatcggagacccatcttcaaaactcatgaccaaccacactccctcctcacccaaacagaaaatcacagctcaacacttctcccatcctttaaaaggactgaatttccttagccctttaaacagaatgcattcatcagaagtaaccgtggcaacagatcagagaggcttcaaaaagcctgtctgtatgtaattaagaaaaatgaggaagagcatggagcttagacggggagaccacggtgctgagccctgccactgcattcactg

SEQ ID NO: 80069 - DNA, 601 bp, Human
ttccagcttaatgcctgcaaataaactcacccgctctctcccacacaccctgtctcaccattctttaaaaaatcatctggcccaaatcacattaagaagcaggagattctatcttaatatggtagcacttgggctggccctgtgggtctagaaggatcctgtttaactccagtgacaaccgtgctccatgcaggctaagccaacctctcaggcacatcctggaggacatcggagacccatcttcaaaactcatgaccaaccacactccctcctcacccaaacagaaaatcacagctcaacrcttctcccatcctttaaaaggactgaatttccttagccctttaaacagaatgcattcatcagaagtaaccgtggcaacagatcagagaggcttcaaaaagcctgtctgtatgtaattaagaaaaatgaggaagagcatggagcttagacggggagaccacggtgctgagccctgccactgcattcactgagggcttttgcggaaggagatggcagattttctttctctgttctggcttccctctctgctcccccttgtaatgtttttgtttagtggtctcaattggcctccttcctggag

SEQ ID NO: 80070 - DNA, 601 bp, Human
tcagatttatgtactcctgcactcaacaaccatgaccttcacaagcccctgttcatgcgccacagatgcatttgctctgaaaagcacacatgaatgggaagggggcagtggctgctttatatgaagacgtttattaaaacaacatggaaaaaaacccttcccctggaatggggggtgggggtgggggaggaaactcactgcatttcctcctgagcagctgggagtaaatgaacagacatggagcagcatcgacaagggtgggtcttcccagctgtcagggaggccactagatgagagactrggcaaaactctccatccagctcttcatttgccacctttgcctcaccaaagcctctgccactcagagtaacaagcagtgggtcatcactgattactgctgctacttcaaggcctctccaaggcccctccatccacctacagcaaggcatcctgtctcacgctggagaggggtatatacatgggaccttttccatgcacactgagcaaaggtagaaaaccaggtgggagggcaaagtgctgtctggggatagtaattacagaaacagaccagacaactgcccctgtctaccaggaggctaca

SEQ ID NO: 80071 - DNA, 601 bp, Human
cagatttatgtactcctgcactcaacaaccatgaccttcacaagcccctgttcatgcgccacagatgcatttgctctgaaaagcacacatgaatgggaagggggcagtggctgctttatatgaagacgtttattaaaacaacatggaaaaaaacccttcccctggaatggggggtgggggtgggggaggaaactcactgcatttcctcctgagcagctgggagtaaatgaacagacatggagcagcatcgacaagggtgggtcttcccagctgtcagggaggccactagatgagagactgrgcaaaactctccatccagctcttcatttgccacctttgcctcaccaaagcctctgccactcagagtaacaagcagtgggtcatcactgattactgctgctacttcaaggcctctccaaggcccctccatccacctacagcaaggcatcctgtctcacgctggagaggggtatatacatgggaccttttccatgcacactgagcaaaggtagaaaaccaggtgggagggcaaagtgctgtctggggatagtaattacagaaacagaccagacaactgcccctgtctaccaggaggctacag

SEQ ID NO: 80072 - DNA, 601 bp, Human
atggaagcccagatagggagatcatgactgctgggcctcagggaagggtcctagtggaatgggtgctagaccttgaagagtgagcaggagttcaagttgatacagagggaaaagaacttgtgacagagggaaaaacattgtgtagaggctcagagataagaagagagtttagtgtgcacaggaaatttcaggaacatttctattagccaaaatatgaggggtgaaggtcaactgccagggatgagatcaagaaaagcaagatcccacgggggcttgaatgacatggaaaggagggcaaccrttttggataatcaggaagcaggggggaaattgtgcagaagaacgctatgactccatgtgcaatttagaactcatactctggcagaagagactatatcagagaaatgcagaagcaatgttggagaattaattaggaggcttttgcaatagggtaggaaaaatgatgaggcccagaattctgaggccatgaggatagagaggaaggaacatgtctaaggaaaagtagaggaagatggacagattgtgctaatggtccatgtgttaggtgatacagaagatgtggctcccagggcctgactgg

SEQ ID NO: 80073 - DNA, 601 bp, Human
ttaatctcaaaatgcccagcattgtggccgttaattcagcaatattttgctcttctgtgaagcaccaggatttccacagttttgcaacaaggcatttcagtttttgccagattgtgaaaagtagccataaacagagctttccagaggaaagaggctgccctctgtgagtcccagtgagcctgtctggtttgtaagagaaggtctgttcagagcagggctatagttgagaacgtgagctttggaatcccgcaggtatgggctttcacactggcttcagttcttacagagctatgcgatctayagccagcctcctttctaagctttacttcccctttctattaaattgagataattattttatcttcctggtaggggtctttggggggaataaataaggtaatgtatataaagcagctagcagaatgtctaaacacattcctgtgttttcttacgtcatggggcccaaagtgactacatgaacctcttccactcaattctgcttcttttctcatgtgccaaagctggtccaatgtaaatatacatctattcaggtgctctggaagcctgtccctacagagatgcatccctgctaccacgcaca

SEQ ID NO: 80074 - DNA, 601 bp, Human
attgtgaaaagtagccataaacagagctttccagaggaaagaggctgccctctgtgagtcccagtgagcctgtctggtttgtaagagaaggtctgttcagagcagggctatagttgagaacgtgagctttggaatcccgcaggtatgggctttcacactggcttcagttcttacagagctatgcgatctatagccagcctcctttctaagctttacttcccctttctattaaattgagataattattttatcttcctggtaggggtctttggggggaataaataaggtaatgtatataaarcagctagcagaatgtctaaacacattcctgtgttttcttacgtcatggggcccaaagtgactacatgaacctcttccactcaattctgcttcttttctcatgtgccaaagctggtccaatgtaaatatacatctattcaggtgctctggaagcctgtccctacagagatgcatccctgctaccacgcacacaccagatagatcccaaatgtgtgagattttgtgcagaatttcagaatatgttagggtttttggaggggccactcatatccttctacccttgagttctacaccaattaag

SEQ ID NO: 80075 - DNA, 601 bp, Human
ttggaattatagatttttctcaattaacaaattctaaaaggacagcttgttagtagaatagcaggagccaagcatctatctctgctctctcttcctctgtgtatctccccctccctgacctcctcttttctactccatccttttctactcacctccccaccctcagactcattctgcttcttttaaaaccaggcatcttaggcatctttgatggcatatgaatcttgagtttaagctgtcagaactgagaagaaaaaaggtgtcgtaggagagcatgtctgtccagatggctgtgttgctsctgtgtgtgggtgtgtgtgtgtgtgttcatgtggtgtgtttgtatgtatgtgtatggtcacgtgtttacatgcatacgtgtgtagtgagaaaataagagtggaaatgtagaagcctccagctggtgaccacagtgttggtgccgtagagacaaaggttgtgacattttgtcttacccaaagaaaggagaatggtaatttctgcattatgttaagcatgtaacatgggcagcctttgttagcagtatttcccttgaagagtttaggcagaaaactggctgaaatattttagtgtcccagct

SEQ ID NO: 80076 - DNA, 601 bp, Human
ttgaatgcgtactctatgtctggaactgcccaaactgtgaagtggctggggactattgagtgggtcctgattgagaaatagatgagtaataattattatagttaacacctcatgtttgtgtttcttttgagttcacaaagaattttggaattgtgtggactcatttaatcctcataattacacaatgacttggggattattgttcctatttttctaataagaaagcagagacttaaagggatttggagaatctaggattagaaagagatcagcaggatgtcccttgtctgtgtctgccttrtggtgttctgtcctaaaagtggacagtacctctgggctccccatttcatagtctccaacaataggctcttcttgattccaagagctgtgatctaagaagagaccttggagatttttgctatcatttgttttttggtcattgggcacatggtagatacagtttttcactcagagacaagcttgtctgttgagttctgagattcagagagccttcatcttctcccatcatgaccccaattatgtatatagtcatgactattcaaggaccaggtatcacttggagagtttcaggactggatcc

SEQ ID NO: 80077 - DNA, 601 bp, Human
atcaagaggtgacatttgcccttggagagggaaaaaccaaattcatcactgcaggtgactgttgatggcagagcactgaacataagctgcccgtgattttcagggaggataagaaatgctttcttgctttctcccatgtgctaaatcccatcgtaataaaatgtaaaccatttagaatgacctgtgtgagaatacacagtcttccacagggcctgtaaccctcatgtcattgccatgaatctgagaaatacaggcagggatggccatcaccctctggcagctcttcccagacccgagtgcygctgactgctggggagtccataccatgtgtagtgacaggagcgtttctctccatggatttcactgtcagttgcctctggatcactctgccctgtgattgcctctttaccatctgaccccaactagactcctgcacagaagtgcagggctgtgactttcttacttgttcttctgtccccagtgcttagaacaggactggcacagtgtttggcaaatatcttgagtttttaatgatggctttccagagagtagaggcaaggagaagaaccaagcccggcaaaatcctcaggccattagcatt

SEQ ID NO: 80078 - DNA, 601 bp, Human
tctagaaatgtctccctgttctcagttgatggcagccccattcttccagatgtttaggccaaaacccttgtagtcacttgactcttctgtttcttccacatcccatattcatggaaatattctaaatagattcagaatctgcctactgtgctgctcaggccaggtcttagcagccattgtttcccagctatattactacagcagtgctgtgattggcttcctgcttttacatggcccctgcattctatttggagcacagcagagagtgataatagtatcatataagtcagattacatcacygtgccttgttgacagtcctcctatggccctccagcttgctcagggtagaagccaaactccttctagtgtccctcagggtcctgccccctgtggactcctctcttctgggtcccactgactccctgatgcccccagatcagcccctttgtcctggctgctccagatacccactcagctccctcccttccctccttcaaccctgtgctcctgcatctgcttctcaggcagccttccctgatcacacacctctcacctctggcatcctgtgtccctttcccctttccattttttcatgtactt

SEQ ID NO: 80079 - DNA, 601 bp, Human
ccttgtagtcacttgactcttctgtttcttccacatcccatattcatggaaatattctaaatagattcagaatctgcctactgtgctgctcaggccaggtcttagcagccattgtttcccagctatattactacagcagtgctgtgattggcttcctgcttttacatggcccctgcattctatttggagcacagcagagagtgataatagtatcatataagtcagattacatcaccgtgccttgttgacagtcctcctatggccctccagcttgctcagggtagaagccaaactccttctrgtgtccctcagggtcctgccccctgtggactcctctcttctgggtcccactgactccctgatgcccccagatcagcccctttgtcctggctgctccagatacccactcagctccctcccttccctccttcaaccctgtgctcctgcatctgcttctcaggcagccttccctgatcacacacctctcacctctggcatcctgtgtccctttcccctttccattttttcatgtacttaatatattttaacacagcttatgattcatttattagctctagtctctgctgaatccccccactag

SEQ ID NO: 80080 - DNA, 601 bp, Human
ggagggggaacatcctttcttacttcagttggtagaaaggaaaacagtgggaagaagataactttcaaataaagatcggaagatatgtaaattggtgagacttacctaagtatagaacagcagctcctggaggcaagaagtctcccctctctgggggtacagcaggagcttggcagcaaattcccaacagggaagttgtagggggaatcaaaactacattaattcagaccctccatgaagcagacacaaagatgggattagatgtatgaaagatttactggggaaatgagatgggagtcasaggaggctgggaaagccatcagaccataagaaaggtctgatctctgtaaaggagagagggaaggaaggaggattgggtagggtaggaagagctttagcttgctgtgggggttataaggtagtgttggaaaggccactggggagtctctgattggaagttgcccatcagagtagtcccatatatcgcaggaatgggtctgccatggcatccctgctgctctcattcattggctgggagcagcctgtgggaatcagggcctctgtgtgaatatggtgatggactgcagagtgcaggaactgg

SEQ ID NO: 80081 - DNA, 601 bp, Human
gggaatcaaaactacattaattcagaccctccatgaagcagacacaaagatgggattagatgtatgaaagatttactggggaaatgagatgggagtcagaggaggctgggaaagccatcagaccataagaaaggtctgatctctgtaaaggagagagggaaggaaggaggattgggtagggtaggaagagctttagcttgctgtgggggttataaggtagtgttggaaaggccactggggagtctctgattggaagttgcccatcagagtagtcccatatatcgcaggaatgggtctgccrtggcatccctgctgctctcattcattggctgggagcagcctgtgggaatcagggcctctgtgtgaatatggtgatggactgcagagtgcaggaactggagctgttagttaattactcttcaaggagtaggaactctgagaggtgcatttcacagccaccacaaggtctctaatgggaacagggcatacctgccttcaaggtcccagaggacactctggctctgagtccttatcacacttctaactctttatggctttcctggactagcagcatcttcagaacaagtgctctgcatcctct

SEQ ID NO: 80082 - DNA, 601 bp, Human; identical to SEQ ID NO: 30164

SEQ ID NO: 80083 - DNA, 601 bp, Human; identical to SEQ ID NO: 30165

SEQ ID NO: 80084 - DNA, 601 bp, Human; identical to SEQ ID NO: 30166

SEQ ID NO: 80085 - DNA, 601 bp, Human; identical to SEQ ID NO: 30167

SEQ ID NO: 80086 - DNA, 601 bp, Human; identical to SEQ ID NO: 30168

SEQ ID NO: 80087 - DNA, 601 bp, Human; identical to SEQ ID NO: 30169

SEQ ID NO: 80088 - DNA, 601 bp, Human; identical to SEQ ID NO: 30170

SEQ ID NO: 80089 - DNA, 601 bp, Human; identical to SEQ ID NO: 30171

SEQ ID NO: 80090 - DNA, 601 bp, Human; identical to SEQ ID NO: 30172

SEQ ID NO: 80091 - DNA, 601 bp, Human; identical to SEQ ID NO: 30173

SEQ ID NO: 80092 - DNA, 601 bp, Human
aatcttgtcatttccctctattcataactattctcttttgatccaaccttgggcacctggctcctctttgcacccaagttctctaaactcagtctcatgcattgaattgcatttgtgcgtttactcctgtgaatatccatttccctgactaaagctattactgttggagaatcatggtcaaaggaatgtagagctggcggatggctcagcacacatacaacagaaggggaaactgaaggctctgatggagggagggcctggccaaagagggggtaggggtagaagtaaggggttagggaastccctacattgggagttttattctggcagctctcttaaactcattgagtcttcacaaccactctaagagaaaggaactaatctaggagggttaagtgacttatctagggcacatgactaagtagcagaggcagactacacaccctctaagccggctgcagagcccatgctctttccacagcctgattatgaggagcagctccaggactaatcccagctgtctaagttggtgttttgtggctccccactctgaatcccactgcaggaggcagaaagattgataatgtctgatccgaatgtg

SEQ ID NO: 80093 - DNA, 601 bp, Human
atatccatttccctgactaaagctattactgttggagaatcatggtcaaaggaatgtagagctggcggatggctcagcacacatacaacagaaggggaaactgaaggctctgatggagggagggcctggccaaagagggggtaggggtagaagtaaggggttagggaactccctacattgggagttttattctggcagctctcttaaactcattgagtcttcacaaccactctaagagaaaggaactaatctaggagggttaagtgacttatctagggcacatgactaagtagcagaggcmgactacacaccctctaagccggctgcagagcccatgctctttccacagcctgattatgaggagcagctccaggactaatcccagctgtctaagttggtgttttgtggctccccactctgaatcccactgcaggaggcagaaagattgataatgtctgatccgaatgtgtgcacataactatatctggaccatccacaggcatgaacttctgggggttgcagacagcaattggagctctgagatcttcctgaccagggagtaacagaaaaccagcagctccccagcttgttcattaatgcc

SEQ ID NO: 80094 - DNA, 601 bp, Human
tctttaagaggaagcagctatggtctactttccttctttgggagacagatgttcagtaataactggtttttggggcagatcccaaaaatgtggtaaaacccccaaacacaaagtgtcaggaaggtcctcctcccacccactgcttttccagcctgcattgtcctccctgaggttcctgtcctgggttcttcctcaagcactggctgggcacccatgacccctgctctcatggaaaaagacaaccacccagtgtcctggtcttagccctcagaggtcggtggggcagactatttctagtgcycgtcagccttcgctagttggtttactccaagaaactgcccagtcttcagccttcctgctaccacccgtgtgcctcccaaacccacaactccagctccactcttctgactctgtcttcagtccgagttttctgaccagcttctaagcacctgcatatttcatttgtacatccaacgtctaaaaccacatgtgccagcacctcttacaataggatttctttccaaaagcccttcacctggttaatagtgccatgtgattctagaggtcttggcattgacttggattcatcttgtccctccct

SEQ ID NO: 80095 - DNA, 601 bp, Human
cactggctgggcacccatgacccctgctctcatggaaaaagacaaccacccagtgtcctggtcttagccctcagaggtcggtggggcagactatttctagtgcccgtcagccttcgctagttggtttactccaagaaactgcccagtcttcagccttcctgctaccacccgtgtgcctcccaaacccacaactccagctccactcttctgactctgtcttcagtccgagttttctgaccagcttctaagcacctgcatatttcatttgtacatccaacgtctaaaaccacatgtgccagcmcctcttacaataggatttctttccaaaagcccttcacctggttaatagtgccatgtgattctagaggtcttggcattgacttggattcatcttgtccctccctaattccccacatctgactgctcatcaactgcaaccacatcttcctttgaaatttgtcttgtctcttctgctgttcttgttgcagtactccggttgaaaactgttatcttacacctgaattagtattacataacaacctcatagctatttttccaacctccagccccttccccacagcactgcatgcaaatgctgcag

SEQ ID NO: 80096 - DNA, 601 bp, Human
ccgagttttctgaccagcttctaagcacctgcatatttcatttgtacatccaacgtctaaaaccacatgtgccagcacctcttacaataggatttctttccaaaagcccttcacctggttaatagtgccatgtgattctagaggtcttggcattgacttggattcatcttgtccctccctaattccccacatctgactgctcatcaactgcaaccacatcttcctttgaaatttgtcttgtctcttctgctgttcttgttgcagtactccggttgaaaactgttatcttacacctgaattwgtattacataacaacctcatagctatttttccaacctccagccccttccccacagcactgcatgcaaatgctgcagcttgccagcaagatgagccccccgatgccccactttcagtacatctgtcccctgctgatggaaccattgtcagctctgtgtgtctcatgacatcaatcctaatgcctctgtttggtaaccaaggccttcccatgcttctgactatcactgattccctccacattcaagctggtatcactctccccactcatgcactgccaggcctcagttagctgtggctcacg

SEQ ID NO: 80097 - DNA, 601 bp, Human
acattataggtatatattacatctgatattattattactgccactaataatatttccccaacactcacaaatctgagaacgttttctgagccctgtctccaaatgtttggctgtgcctgactctgtagctgacttgaattccttgttcactgtctgatgattcattgcactaaacaccattttcctgataattaaaaactgctcactggcaagtgggagcaggaacatgctgatgtaggatttatgcagaaacacaaaatgagccaaaagacaaatgacctgttctgcctagctaaaggcttttttttcccctcatcatcttctaagatttggaaaggctagctatactgcaggagggaggtctaggaagatgcgtcattctgagatgaggcggatacaggggagcccttacgtgcttggttgagagtgctcaaccaagtcactctcccgatttagaacacagactgccgccccacacagaggagcaacaccaaggccaccttcccagcccaccctatcagaccttaggggaaagtcattgagtttgagccatttgttagaccaatgattcactttttcagtttcccttcttcaatgtgac

SEQ ID NO: 80098 - DNA, 601 bp, Human
atatatgtgtgcacacacacacacatacttcttaattctacaagctagcaaagcagcacacctctcttcgtcagtaaagtgcacccatcttcacagtgcagactttgttccgtttatgtgcacttatttgcgcattactggcccaaaagaatcctggcaccattaagagataagccctttcccttctgggaatagctccttccttgaactgattggggccaatatctgtaaaactcattaactcagaatcctttcccattcatccttatgtatgtctttacttgcaaaccattcattaccrcatattctagattgtttaattaatttccatggaagagttcctgtaggacagcttagcatacatcgttcaaaagcctttgatctaaaataacaaggtagttattttcgaagtaactaatataaccctaagcggcttacaacccccactgcccaccctccgcttgcttcctcttcctacctccccaaacacttcctagaacaatttactgatgatataacaagtctatcagtcagtgagtcatcactgtacatcaggcactgtgctaggtatgtcgtcagcaatatgttctttaatctcaca

SEQ ID NO: 80099 - DNA, 601 bp, Human
ctacctccccaaacacttcctagaacaatttactgatgatataacaagtctatcagtcagtgagtcatcactgtacatcaggcactgtgctaggtatgtcgtcagcaatatgttctttaatctcacagccactttgggagggagatgttaccgccctcataggcagaggagaaaaccatgctaagaggtgtgtgccgacttgtcacattacacggggctagtaaaaggtttgggggccctgacctcacctgtgggtcccagcatctgggctgtttacgtcctctcaccacagcacagaatwtgggagaagtcatagcttgttaacgctgacctgctgtcccttttgcattctgagtgcatctgttgctgccagtcgcacatcagctgacttccacctgtggcatcagtgtttctttgcctgactgctttccctggccctggagcctcccctgcccacccgtacaacaggccaagcagcccctgaccaattgtgtggaaatatcacagctcccttgaccccagagtgggacaactctgaagcatgtgctaacctagacattgcttagatgtgaatctcaggggaattaggcctgctcaatga

SEQ ID NO: 80100 - DNA, 601 bp, Human
tgctaggtatgtcgtcagcaatatgttctttaatctcacagccactttgggagggagatgttaccgccctcataggcagaggagaaaaccatgctaagaggtgtgtgccgacttgtcacattacacggggctagtaaaaggtttgggggccctgacctcacctgtgggtcccagcatctgggctgtttacgtcctctcaccacagcacagaatttgggagaagtcatagcttgttaacgctgacctgctgtcccttttgcattctgagtgcatctgttgctgccagtcgcacatcagctgrcttccacctgtggcatcagtgtttctttgcctgactgctttccctggccctggagcctcccctgcccacccgtacaacaggccaagcagcccctgaccaattgtgtggaaatatcacagctcccttgaccccagagtgggacaactctgaagcatgtgctaacctagacattgcttagatgtgaatctcaggggaattaggcctgctcaatgacccacagtggtcagtggcttgagaatgcgcctcttataggctgccttcctttccctatcttacttcccttctcatctcaggtacttc

SEQ ID NO: 80101 - DNA, 601 bp, Human
aaacaagtgactgggaataactcatctttcagaaaaaaactgttctgggcagggcacctggccctccttatcttaaaaaataatcccctcaggccaggcgtggtgactcacacctgtaatcccagcactttgggaggccggggagggggggtggatcatgaggtcgggagttcaagaccagcctggccaagatggtggaaccccatttgtactggaaatacaaaaattagctaggcgtggtggtgcatgcctataatcccagctactcaggaggctgcggcagaagaatcgcttgaacccrggaggtgaaggttgcagtgagccgagatcacaccacaccactgcactccagcctgggcaacagagcaagactgtctcaaaaaaaaaaaaaaaaaaaaattctcctcaatggtttgctgtatcttctgtcttcctttggattacactctagtctaatttccagtccttgcctgaattggtgaccaagcaacaccagtttaggagagctatagagccatcagaagttttttggatggaaaatgtcaaaactagagctgggggtcaccagggaacaagctgtagtggcaaggggtggggaaca

SEQ ID NO: 80102 - DNA, 601 bp, Human
gtcctctttgggatgttaaccctgcttatctcctccaacaaggctccccagggatgaagatctacattgaccccttcacttacgaggatcccaacgaagctgtccgggagtttgccaaggagattgatgtatcttttgtgaaaattgaagaggtcatcggagcaggtatggctcttccctgtcttgtttctgttctcctggtgtccaaacatcttctttccaccaccctagatggtctctttcagtatgaaaagccccattaggaggagagcttctatcttctttctcctcagaagatgartctgaactatctacatgtgtatctaggacagagagaaaacatcacttgggatctttggggaccttgaccatggtggccaagcttgtctgttgttgcagaaaagtcagctgcagttttatagattcagaaataactctggaaatggaccaccaaatgcagataaggtacttagttgagaaggctttgaaagaaatctacatttgtagtattccacttactaacaatgatatctcaatgggttaaagtcaagatatcttgccatactgtaagttctccatttcctatgtacatgaatttgaa

SEQ ID NO: 80103 - DNA, 601 bp, Human
tgtgtatctaggacagagagaaaacatcacttgggatctttggggaccttgaccatggtggccaagcttgtctgttgttgcagaaaagtcagctgcagttttatagattcagaaataactctggaaatggaccaccaaatgcagataaggtacttagttgagaaggctttgaaagaaatctacatttgtagtattccacttactaacaatgatatctcaatgggttaaagtcaagatatcttgccatactgtaagttctccatttcctatgtacatgaatttgaagacagaccatgatgartagaagagagaccactgtttccagaagaaagtcaacctatcaccttcttttttttgtttgttttctttgtttgtttgttttacaaaaaatctatggtacagctggtaacaacacaagacgaatttcactctcaagaaatgtgtgtgccctcatccatcttcctgcactggaatagaaacccagcccagtgtaaaactcactgcctgagatgctctcaggaaatcatacctaagactgatctagaattttcatcttcctttaatgggttagtagctgagtcaatttggcaatggacctaga

SEQ ID NO: 80104 - DNA, 601 bp, Human
aaatgatttaagaaggataatgaacatgaccttccagcagtggacatgctatgctggacagcctgcagtagcttgcaagagccaattatgcacatctgtttctagccccatgtttagtgacaccatgttggtagcttgacatcagccatagtagaagtatttacatcatgggaatgggcaaatgctacaaatcctgagcctgccctctgtttgttctttcgtttcttttctcttttcttttcttttgctttcttttcttttcttttcttttcttttcttttcttttcttttctttcttttctttctttctttctttctttctttctttctttctttctttctttctttctctttctctctctctcttcctttctttcttcttgacatcaatcatagtgggagtatttacactatgggaactggaaaatgctacaaatcatgagccccttctttccttcctcccttccttcctccctccctcccttcctccctccctcccttcctccctccctccctttcttccttccttccttccttccttccttccttccttccttccttccttcctggagagctggtagttgaacacttataagcacac

SEQ ID NO: 80105 - DNA, 601 bp, Human
ccagaggctgctatatgaattttatcccatagaaaataggtttcatagcagggtgggtgaaaggaccaaggttctagcaagctgaatcctataaatgctgtgcttggattggactggaagagggggatgggaaacaatcgctaaaaccttggaggtgggaagacaagttatgaggttttgtttagatgttacagagaggctttgagatggttgatgctaggatcaaggctgcatttaagtgactaagcttatccaaactggggtatacccaaatgaatgtgatgaatggagtgactagtgrgcttggtgcctggaggtgatggggagtcatagcatggaggctgtgatcagaaatgaggggcatcaggttaagggagagtaaggctgcctggcacccaggttgtggggagtggcagttgtgcatgtgagtgaagacccacggagggaaagttcagaaattgtgaggctgaaaagttgcatcagctgccaaagtttctcctaaagttgttgcaaatgttgatcaaagaaataaaaatataataattgtgagccaggtgtgatgccacccaagaagacaataataaatcattaattattaagt

SEQ ID NO: 80106 - DNA, 601 bp, Human
gagtgaagacccacggagggaaagttcagaaattgtgaggctgaaaagttgcatcagctgccaaagtttctcctaaagttgttgcaaatgttgatcaaagaaataaaaatataataattgtgagccaggtgtgatgccacccaagaagacaataataaatcattaattattaagtaattatttgtttaatgttcgtctttcctcacaaggctcaaagttctatgggagcaagggaatgtatgtgttttgttggtctggtacctggcctagtgcatggcacttaaatgctcaattaaatatytgttgtatatggcgaatgaaagtaggtccttggagggagaacatggcagttaaaaatctggagaactaggtagtgtttgggagaatgaagagagactggacaggtggcatgagatcatgagtcatttgatgctctgaaagtggcccagtagagtgaaggaaagctgactcttcctcttctcactgcagataatgagagtaattgaagtatcttcacagagggcagcaggttaccttggtatcttcagagagtaccagtttattgttaccatgagtctgactaataggcatcatgtcatag

SEQ ID NO: 80107 - DNA, 601 bp, Human
gtagacttgcccagaacatgaatcagggctctacagcttgaatggcactcctgggtgcagtgtgaaacctgtataactgtatgcaacagcctaagcatgactgtcagtgtatgactacataggtaaaggtgtcactagaagttgttggcagaagaagacatgccatttgtattttcatgaataaatatgtctcctctgactctagcagctagtgattcaacatttccaggaatggatgatcatctggaagaaggaagcttgcagtgaaagggctgtgtgagaatagttgggatgagggaawgtgtgatatgtgtggatggggatggagtcatctgtgaggccaacaaaggcccgggtttccttggggatgatttggcagaaaggtcacttgcaagtttgacagtcctggggtcattcagagtgcagatggacagcatgagggtagctccacattgaatagaagttacggcaagaagcatttctaggagaagaaatcatagacatgtctccaggaacatagtcaaagtagctagcatctcttgaacactcaccgtgtgtctgacaatactctacatctttcacaagcatcgtcttatttaag

SEQ ID NO: 80108 - DNA, 601 bp, Human
tgtgtgatatgtgtggatggggatggagtcatctgtgaggccaacaaaggcccgggtttccttggggatgatttggcagaaaggtcacttgcaagtttgacagtcctggggtcattcagagtgcagatggacagcatgagggtagctccacattgaatagaagttacggcaagaagcatttctaggagaagaaatcatagacatgtctccaggaacatagtcaaagtagctagcatctcttgaacactcaccgtgtgtctgacaatactctacatctttcacaagcatcgtcttatttaastctcttattgctctgtgagttagagcatatatatctgtatgcatgtatattttcttgtaactggtaaggaaatcaacattcagaggatagcttgccgaaggctgtgctgccagttaagtttatgatagagctagaatttaaacccagctagagctgatccagatctggagaatgtaaccctcacatgaatgtaaccctagggctgttgcgtatagttacagagtggccagctgccactcttgttgctatggaaaagagcagctcagtatacagaggcattgcttccgatggcattttgga

SEQ ID NO: 80109 - DNA, 601 bp, Human
tctgtgaggccaacaaaggcccgggtttccttggggatgatttggcagaaaggtcacttgcaagtttgacagtcctggggtcattcagagtgcagatggacagcatgagggtagctccacattgaatagaagttacggcaagaagcatttctaggagaagaaatcatagacatgtctccaggaacatagtcaaagtagctagcatctcttgaacactcaccgtgtgtctgacaatactctacatctttcacaagcatcgtcttatttaagtctcttattgctctgtgagttagagcatatrtatctgtatgcatgtatattttcttgtaactggtaaggaaatcaacattcagaggatagcttgccgaaggctgtgctgccagttaagtttatgatagagctagaatttaaacccagctagagctgatccagatctggagaatgtaaccctcacatgaatgtaaccctagggctgttgcgtatagttacagagtggccagctgccactcttgttgctatggaaaagagcagctcagtatacagaggcattgcttccgatggcattttggaatacccattgcttctctctagcagttttgaa

SEQ ID NO: 80110 - DNA, 601 bp, Human
tgtgatatataggtatgcagttgtttaacaactataaaaagctacaagaaaagagaaaaccattttccctcactctctggatattaggtattgtgaataccgtggctgtcaagcaggttccatctcatgtgccaactcagtggcctggtaatgagtatctgaggaactctgatgaaagggtgaagatggttgtgatcaactaataatgtctatcctctgtgcagggtcaggaagtggtggagtgtgtaccatggttctgctctccctggtttagccgtaactcatttatcttgcacaagcyagtgtgttaaaacttgcttgaaatcatgctttaaaacctagtttaaatgtattctttaaaaattccatttctggtgtaagcttgaattagtaactagaagctctgctttcctttttttccccccaaggcagtttttgacttcaaaatgctgcttttttaaaaaaagtgcaattgtgtgtagatttgagctgtgcataaccagaagctactgcttgaaatacctgctggcaggtgaatgtttcgttttcaaaaattgagaattcttttcttctgattttacatacaatagttgaggcattt

SEQ ID NO: 80111 - DNA, 601 bp, Human
gtctttttaaaacaggcctggcatggtggctcatgcctgtaatctcagcactttgggattctgaggcaggcagatcacctgaggtcaggagttcgagaccagcctggccaacatggagaaaccctgtctctactaaaaataaaaaaattagataaaagtggtggcacaagcctgtaatcccagctacttgggaggctgaggcaggagaatctcttgaacgtgggaagtggaggtagcagtgaaccgagatcacatcactgtactacagcctgggcaacagagcgagactgtctaaaaaaawaaataaataaaggccaggagtgatggttcacacctgtaatcccagcattttgggagcccaaggtgggcagatcacgaggtcaggagttcaagaccagcctggccaacataatgaaccactgtctctactaaaaatacaaaaattagccgggcgttgtggtgggcgccagtaatcccagctacttgggaggctgaggcaggagaattgcttgaacccgaaaggccgagattgcagtgagtcgagatcacgccactgcaatccagcctgggcgacatagcaagactctgtctcaaaaaaaaa

SEQ ID NO: 80112 - DNA, 601 bp, Human
ctccactcactaccaattttcctcccaactgtactcaggggcctacttaattacaggggcgaacataatctcctggtgaggattagatattaagtggcattctttgcagttggtgctttgaaaacctcctggcttggagaatatgaagacacttctttgccagacaggaaaggaattcttttacagaatttccattctttaagtcactgcagagcagatttctgagagcagtgacaccatgaccacgaaggtaaccaaccacaaagtccaccatgccctacccaaagaaggcatgtttatrttttataatttttaaaaactgtatgatgagtttttagacttgaagaccagtcacaaagattaaaaattaaataacgtttcccaattaggaaagtagtttgattcatactgtcctatacatcttcattgatttcttccttccttcttttcttctttctctcctctcacatctataaagtccatactatgtgccaggacctgtgctgtatgaggcaggctatatgtgtgctttgctttcaaaagtattcagaagtacagagagaaatttcaggaatgccatggcttttggcagttcactaat

SEQ ID NO: 80113 - DNA, 601 bp, Human
tagtatacttaccaaatatgtaatttgtgttcattcagctcatagttatatatatatagcatatatatgctacgtatctacatgcatacatatatgctacatatatacatgcatacatatatctagacatatatacatacatccacatatacacacacatatgtgacaggtctgtattgtctagtacttttctttaaattttactcattttaattactaaataagttaagctattgtagtgtttgtctatagaagatgatgctgcagtaaatatatttttaacatacaaattcaaatagtrgtacttctatttctggataaagcagagataagaatcttcagcagtttgtaacccaagagtgagcaaggcaaaagccaaacatataataataaatatgatacaacaacttttactggcatgtctgctatgtgccaagcaccacagtggagtggatgtgcaagctacaaacaggaatgagacttggtctgacctccagcagttcaccaaaagagtatatgattcaatgtgaaaagcagtgttgcagccaggtgcagtggtgcacacctgtggtcccatctactcaggaggctgaggcaagat

SEQ ID NO: 80114 - DNA, 601 bp, Human
tgtctatagaagatgatgctgcagtaaatatatttttaacatacaaattcaaatagtagtacttctatttctggataaagcagagataagaatcttcagcagtttgtaacccaagagtgagcaaggcaaaagccaaacatataataataaatatgatacaacaacttttactggcatgtctgctatgtgccaagcaccacagtggagtggatgtgcaagctacaaacaggaatgagacttggtctgacctccagcagttcaccaaaagagtatatgattcaatgtgaaaagcagtgttgcrgccaggtgcagtggtgcacacctgtggtcccatctactcaggaggctgaggcaagatgatcgcttagcccaggagctcgagtatagcatgagcaacatagtgagaccctgtctcaaaaaacaaaacaaaaaaaaaggagtggaagggaggaaggaaggaagggagggagggacagagggagaaaaagggaggaaggatggaaggaaggaaaaagaacagcccccccaaaacacatagtgttgtaaatgatatttatctgagtattaggtccatgttgaaatcttcctaatggtgcttaac

SEQ ID NO: 80115 - DNA, 601 bp, Human
ttctatttctggataaagcagagataagaatcttcagcagtttgtaacccaagagtgagcaaggcaaaagccaaacatataataataaatatgatacaacaacttttactggcatgtctgctatgtgccaagcaccacagtggagtggatgtgcaagctacaaacaggaatgagacttggtctgacctccagcagttcaccaaaagagtatatgattcaatgtgaaaagcagtgttgcagccaggtgcagtggtgcacacctgtggtcccatctactcaggaggctgaggcaagatgatcrcttagcccaggagctcgagtatagcatgagcaacatagtgagaccctgtctcaaaaaacaaaacaaaaaaaaaggagtggaagggaggaaggaaggaagggagggagggacagagggagaaaaagggaggaaggatggaaggaaggaaaaagaacagcccccccaaaacacatagtgttgtaaatgatatttatctgagtattaggtccatgttgaaatcttcctaatggtgcttaaccagcctctactccagccccaggttctatcaagttctgttgactctggagaagttttgcataa

SEQ ID NO: 80116 - DNA, 601 bp, Human; identical to SEQ ID NO: 30174

SEQ ID NO: 80117 - DNA, 601 bp, Human; identical to SEQ ID NO: 30175

SEQ ID NO: 80118 - DNA, 601 bp, Human; identical to SEQ ID NO: 30176

SEQ ID NO: 80119 - DNA, 601 bp, Human; identical to SEQ ID NO: 30177

SEQ ID NO: 80120 - DNA, 601 bp, Human; identical to SEQ ID NO: 30178

SEQ ID NO: 80121 - DNA, 601 bp, Human; identical to SEQ ID NO: 30179

SEQ ID NO: 80122 - DNA, 601 bp, Human; identical to SEQ ID NO: 30180

SEQ ID NO: 80123 - DNA, 601 bp, Human; identical to SEQ ID NO: 30181

SEQ ID NO: 80124 - DNA, 601 bp, Human; identical to SEQ ID NO: 30182

SEQ ID NO: 80125 - DNA, 601 bp, Human; identical to SEQ ID NO: 30183

SEQ ID NO: 80126 - DNA, 601 bp, Human; identical to SEQ ID NO: 30184

SEQ ID NO: 80127 - DNA, 601 bp, Human
gagggaatccaagcaggtagacactggtaccagaggcatctgtcagcagagagcagaccccaggcatgcatgaggccttcagtctgcagctgggttgggaactgtgtcactaggtagactcttgatccccttctctcttctctctatattgcttccaaatagctctaagtaccgtcaacacgatgagtactcttaaacttgtatttcctgctcagcctccccctctacattctgagcagctctaattatctatatccaactgcctagttcacacaatttcatttagaactttaacaagccsaaaatagagcttgggatttactctccaatatcctctccctagtccctccatctcagtagttggcaccacttaactaaagaatgaaacctaggaatgatgtttgatttctttctgtgtccatttattttcaatccctcagcggcccccatagggtaccaaaaaatctatccctctttccatctctactgcccccaccctattccaaagcaccattccctttcacctggattgttacagtggcttcctaactggtgtccctttccttttgtctccttacatccatttcaacagcacccaaag

SEQ ID NO: 80128 - DNA, 601 bp, Human
tccatttcaacagcacccaaagtgactgatctacctactaacctgtctatctgtctatcctctttaaacctgcaaaagtaatgcataattattacaaaaatcaaaacaatgcagagaagtaaaaggaaacgccaattagaatggcaatcattaaaaagtcaggaaacaacagatgctggtgaggctgtggagaaataggaatgcttttacactgctgctgggagtgtaaattagttcaaccattgtggaagacagtgtggtgattcctcacatatctagaaccagaaataccatttgaccsagcaatcctttactgggtatatacccaaaggattaaaaatcattctactataaagacacatgcacatgtatgttttttgcagcactattctcaatagcaaagacttggaaccaacccaaatgcccatcaatgatagactggataaagaaaatggcacatatacaccatggaatactatgcagccatataaaagaatgagttcgtgtcctttgcagggacatgcatgaagctggaaaccatcattcttagaaaactaacacaggaacggaaaaccaaacactacatgttctcactcataag

SEQ ID NO: 80129 - DNA, 601 bp, Human
ctccatgagttcaattgttttaatttttagatcccacaaataagtgagaacatttaatgtttatctttctgtacctggcttatttcacttagcataatgaccttcaattgcatccgtgttgctgcaaatgacaggatctcattattttttatggctgaatagtactccattgtgtataagtaccatcattttgttttaatttacattttcaactgactgctagtgacattgatatcttttcacatggtgcagggatttgtgttttctattgtttgtacgtgtccttatctatttttctatygggttgtttgttgatttctgagaaacttatagaaagtctttttatattacagacattactcctttgcctgccatgtgtgatacaatttatcttttcccccatctgttattcctttatactgtttatgataccctctggcttataaagtggttaacattcatgtaatagctatgtcttcttgggttacctggtttattttaaaagttatgttcactccaaggctataaaatatttcctggtttcctgggctattttattgggaagggggtttgttttatatttgaatatttagtacctgtg

SEQ ID NO: 80130 - DNA, 601 bp, Human
ttgatagaatttggcagagaacagtcatatgcctaccacctagattctggaattaatatcttggtacatttgctttatcatgtaactatccgtctatccatccctctgcccatccatcacaccatctattgttttgatgtatttccaagtgatttgcagacatcattacatatcacccctagccattttagcatacatgtctctaacatgtatttgtttatggttcttttttaaggtaaagtgtgcatagagtaaaactcacaagtctcaagtgtacatttatagagtttttaaaaatgcrtgcaactgtgtaacccaaactttcatcaagatacagaacattgccatcaaaccaggaatccccctaacctcatccctccccattgcatcctcacccacatccatacccagaggcaaccactgttctaatttttttgaccatcaattggttttataacttcatataagtggaatcatacagcatgtgcttttttgcatctggttgctttcacttgcattatatttaagagaaccgttcatgttgtgtgtgaagcaggagtttgttccttttattgctgagtaatattccatggtttatttg

SEQ ID NO: 80131 - DNA, 601 bp, Human
attttagcatacatgtctctaacatgtatttgtttatggttcttttttaaggtaaagtgtgcatagagtaaaactcacaagtctcaagtgtacatttatagagtttttaaaaatgcgtgcaactgtgtaacccaaactttcatcaagatacagaacattgccatcaaaccaggaatccccctaacctcatccctccccattgcatcctcacccacatccatacccagaggcaaccactgttctaatttttttgaccatcaattggttttataacttcatataagtggaatcatacagcatrtgcttttttgcatctggttgctttcacttgcattatatttaagagaaccgttcatgttgtgtgtgaagcaggagtttgttccttttattgctgagtaatattccatggtttatttgtccattcacttgttgatagacaccaggaatattccggaattcatttttgactatgtattgggaagtatattctcacactgttttgttcaggtgaacaattatgccagcactacttattaaatatattattcattttttattgaatcatatgtcatccttgacatattaagttcattatatgaaa

SEQ ID NO: 80132 - DNA, 601 bp, Human
atttttgactatgtattgggaagtatattctcacactgttttgttcaggtgaacaattatgccagcactacttattaaatatattattcattttttattgaatcatatgtcatccttgacatattaagttcattatatgaaactatgttttgattctcaattctgctcttttaatctatttattcttatgctcaaccgtgttgtcctgattataataatgttagcaaaagttttcctgtctgtattctgattatagtaattttattaaaagtcttactgtaggttgggcatggtggcctgygcctgtaatcccagcactttgggaggccgaggtgggtggatcacctgaggtcacgagttcgagaccagcctgaccaacgtggtgacaccccgcctctactaaatccaaaaaattagctaggtttggtgactcatgcctgtaatcccagctacttgggaggctaaggcaggagaattgcttaaacctgggaggcagatgttgcagagagccaagattgcgccattgcactccagcctgggcaacaagaggggagccccatctcaaaaaaaaagtgtcttactgtctgggtaaagcaagtta

SEQ ID NO: 80133 - DNA, 601 bp, Human
tgggaggcagatgttgcagagagccaagattgcgccattgcactccagcctgggcaacaagaggggagccccatctcaaaaaaaaagtgtcttactgtctgggtaaagcaagttatccttcattatccttcttttaagaaaaaaaaaagcttccttgactgttctcaaatatcttttctttcaagtgcaatttaaaatcttcctgtccagtttcaaaacatgcacatatacatgtatactcacatgtggattttgactgaaattctactctgtctttaggaagattaacatttcaatgatsctaagtcacctaaataatgatgtcagccaaatatacaatttacatatacacgacattaaaagtttctttggtaaaagatttcccacgttatttttctgtacacattatttggattacttgctgtgataagtgtctttgtagatgatagagcttatatgtttctaggcctaagagttctcaggattctacacagtgatatggccacctgtctcactatattttactatcatttctccacactttgccttttattcaaaatagaaaaaattatttttgattattaagcaaatattttttcta

SEQ ID NO: 80134 - DNA, 601 bp, Human
aaataacaaaattgcctaactgtgtctaggagggcttgcagaggaagagatggtgctacagcagagacttaaagaacagtcactgttttagtcagcctgggctcccatagcaagctaccacaccctggatggcttaaacagcggtcatttatttcttgtcatctgtaggcttgggagtccaagatcaaggtgctaactagggatggttggattcttattgagggctctattcctggttatgtcctcagatgccttttgttggcatgtgcacagaaagagagatcttgcctcttcctctttkgaaagcacatcaatcccatcttggggactccaccttcatgacataaactaactgcagtcacctcccagaggctccaccttcaaatatcacccaattggggattattaggacttaaacatatgaatttgggggacacataaacattcaatctacagcattctgccccaactaaatgtggcaggtcggacttcagaggcagagaggcagcatatacaaaggccctgtggcaagagggaagatggagtggaactgagaagggacccctgtttagggcatttggagatttagggaggaagcatc

SEQ ID NO: 80135 - DNA, 601 bp, Human
tcaaaaaatgttagggtcgtgaaagtcaaggagacagagaaactgctccagattgaggggcatgatactgggtataccatgtgatccttaacaggacatctctaggacaattgttgggctggaatagggtgcctaagggaagagtgtacaggcattcattgtagtattcttgcaacttttatagatatttgaagttgtctcaaaataaaatatatatatttttaaatttaccttgactgcagcatggaggatgggtgggagaggcactagtagagacaggaagatgcatcaggaggctacrgggcaatgggcctgggatgcagcaaatgaatcccagaagttctagtggggtgatgcagaaggacttgacagcagatgccacttacaggtgaaagtgacagatggcggaggatgactccaagtatccagcctgtgcctctggatgggtgatggctccattctctgagagtgaggatgctggagagaaattggttgaaggagtagaagagttgggaatagattgtgggtttggttcagaatagttattctcaaattctcaattctcaaattctcaaatgttgttgagtatcagatttacctg

SEQ ID NO: 80136 - DNA, 601 bp, Human
gcagagatgggcagacacttaacttttacttattcttgattttcagctttacttctttgcatttacttttttcatagttactctagaactaacataataatatgtaacatatgcatatataatatatacgtcttaatttttcctagtctactttgagttcatattgtaccactttacataaaatgtagagaccacataatcatatcatatagatccatttaaccatccactcccactgctctttatgttatcattgttatatatgttccatctacatacatttatagtcccaaagacaatrttacaatttttgctttaaacagccatgtgtattttaaagaaatcaagaggaaaatgttttacattgcctcaaaatagttatcatttctcttgttcttcctttattcctgaagatccaggtttccctctggcatcattccttcagtctgaagaactacctttaacattttttgtagtgcaggtctctggcaatgcatttcttagttttctttatcagagaaatgtctatattttgcatttattactgaaatatatttttgctagatatacacttctggtttatagtttgggttttctttca

SEQ ID NO: 80137 - DNA, 601 bp, Human
ttgtttgctagagtccatttgttagaaacatactggacaccaaaagtggaacattcagcttatccccctaatcagcagttctataagacagtacttaagacctctctactccatcttaattcccctattttatgcagttctttcaagatctttttaacatcaccatcttctaatacatctggttttactttgtaagtgaagacctcgttaatagctattaaagttttctagtttttcctaccaggtcctcaaacttcatctctcactctgccttaattctccaccttgttttcccccaggkgttccttctgttttagatcgctatttctagccccaggagcatttccttcccaagaagctcctgaaataatgaacagatcgaattttctcctttgcgctttcttatgattggaataaatccactaaactaaggaatagttctgaactgctactaatattcctgctctttaagagaaacagacaaatgagctaggctggactctgaacacttgcatggtttacgcaactttgtttttggcaggtatatttctgaatgtcgttatgtgtgttcaaataaacattcccatgcttctgttataga

SEQ ID NO: 80138 - DNA, 601 bp, Human
ttctataagacagtacttaagacctctctactccatcttaattcccctattttatgcagttctttcaagatctttttaacatcaccatcttctaatacatctggttttactttgtaagtgaagacctcgttaatagctattaaagttttctagtttttcctaccaggtcctcaaacttcatctctcactctgccttaattctccaccttgttttcccccaggtgttccttctgttttagatcgctatttctagccccaggagcatttccttcccaagaagctcctgaaataatgaacagaycgaattttctcctttgcgctttcttatgattggaataaatccactaaactaaggaatagttctgaactgctactaatattcctgctctttaagagaaacagacaaatgagctaggctggactctgaacacttgcatggtttacgcaactttgtttttggcaggtatatttctgaatgtcgttatgtgtgttcaaataaacattcccatgcttctgttatagactagttcttgatgtttgacctcacaggtcaccttctcattattactggttctgtctaatgttaccaagagaaaagagg

SEQ ID NO: 80139 - DNA, 601 bp, Human
tctctgtaagcacctggtgccatggcccatcctgaacctgctggaggaagccaggcctgtcactcatgtgcgctccagaggtctttgttctgtgacgaatttcagtcatcccaggtcatggtgtaggcagcaccctcatctcaccaccaccaaccccacacacacccattatccattattcccatgaattattgtctcagctgcagcctccatcctcgctgtgcttccaggagagagcatgcatttcagccacaatcgcttccatgctgaaatctgtagggcccttcctttcacaaaattyggccttcattcatgatattgtactgcccaattgatccctgtgttcagcaatgtcgcctgagaaaggggcaaaaagaccatttctagaactttctttcccagcatggtgtggtgaaatagttctttggcatggtacgaggaatgcagggtttggatcacactatgctttatgaacttgggcctagttctcttcatccataaaatggggtttgtatgattttgttagatttgtaaaaacccatctgataaactggtgaacatgctaggacaagttccgtcctggtcacagcttatatgagtg

SEQ ID NO: 80140 - DNA, 601 bp, Human
ctttctcactttccagtcactctataacagaaaacaataaggcagacagccaccagaaatccagaaaagctgatattcgcgaaggaaaattgaggacctcgtggcaggatcaccatgggaaaattctgaggaaaccctgtcaagagagaacaggggaaaagaaactaaaatgactgtgtccattgaaacctgtggttctcatgcttccctggggaccagagtttcctggagggcttgtaaagacacagactgctaggccccacccaagagtttctgattcatggatctgaggtggagcctwggaatctgcatgtcacgtgagttcccagatgatgccgatcctgctagtcctggaggccacttgaaaaacctcttcattgaaaccgtttcagggagcatgaattttatttcacaaacttgcattgtaagaaatgtcaattaccgtatttctcaaaaatccaagtaaatctgacaccaaatccccatcctgtcaggctggaaaagaaagtatattttcagtcatcttagaacttctccttctccaagcccagggaagcatgaaggccccagaccacacttgggctccagcatcttttcacgg

SEQ ID NO: 80141 - DNA, 601 bp, Human
cacacacacacacacacacacacacacgcacacggggagagagagagagagagatgtgtgtagtgtagttatgcacatgttgttacgcaaagcatagttagagatacacagtgaaattcagagcgatgtacacacagaactatacgcaatcacccagggctacccagaaacatacaagtacaggcacaaacattccgagtaggcaccaggtaatagctggacttttttctctcattacccctgagcagtgagtttgactgcaacagtactctgtttcagatttttttaataatgcacttartacattataaaatgtgcaaagaaagcagaaaattatctccaagataatcctttctgcaagattttcaggaaaaagctgtctgcactttgctgcaccactgtaagaagttgcttctcagtcgggtcgatccatctgcctgatagattttggctaaggctatgaccttcatctgtcagaacgggcaaggtttactggctttctgtccagtgaccccaggtccagctttacttctccccatagctcctggcagtatttacatttaaatcatagttttcttctcttctgattcatggcctgcct

SEQ ID NO: 80142 - DNA, 601 bp, Human
tagcatgggtgggatcagtatggaatttcagagcctgagccagcatgtacccagggactggaacaaggagtgggtcaggtttctcagaaaacacatctctccattctgggccccacaggggtgtgatatgcaaagccctcttcctcaatatgcctgtcatcatgtgggaggggccagccacctgggtgcaggcccatgcagtgcctctactggctgttctcctagccaatacatatttttaaagcagctaatatgtgcataacactgcagttaacaaaacaggtagttcctgagctcctcmagtttccttcctagcaaaaaaagacagacattaaacaactaattatgcaagtaattatataattgcaattgttaggtgctatggcggagaagcatatatcaagcgtgtatcacaagaccctgaagaaggaacacctgtgttgaagcccaaggacgaaaaggggttaattagggtaagagcatggccagtgcctccctcatgggaatgatcccagagctggacacagactctgcttgctcagcaaggacagagtgtggaggagaggagggagttggaggagcctgagctcaagcacaggtg

SEQ ID NO: 80143 - DNA, 601 bp, Human
cagccacctgggtgcaggcccatgcagtgcctctactggctgttctcctagccaatacatatttttaaagcagctaatatgtgcataacactgcagttaacaaaacaggtagttcctgagctcctccagtttccttcctagcaaaaaaagacagacattaaacaactaattatgcaagtaattatataattgcaattgttaggtgctatggcggagaagcatatatcaagcgtgtatcacaagaccctgaagaaggaacacctgtgttgaagcccaaggacgaaaaggggttaattagggkaagagcatggccagtgcctccctcatgggaatgatcccagagctggacacagactctgcttgctcagcaaggacagagtgtggaggagaggagggagttggaggagcctgagctcaagcacaggtgggggaagagttgccctcccacagaaaaggcccaagagatactgaaagaaactgaggtagacgtaagcctcagcagaacagaggaggctagaaagtacttgatgtgcttactggatagtgaacaggaggcctacttggctagtgtttggaaaagagtgtgaaaggtgtgttagct

SEQ ID NO: 80144 - DNA, 601 bp, Human
agactctgcttgctcagcaaggacagagtgtggaggagaggagggagttggaggagcctgagctcaagcacaggtgggggaagagttgccctcccacagaaaaggcccaagagatactgaaagaaactgaggtagacgtaagcctcagcagaacagaggaggctagaaagtacttgatgtgcttactggatagtgaacaggaggcctacttggctagtgtttggaaaagagtgtgaaaggtgtgttagctctggaagggccctgggatcagttgaattgtatccctcccaaaaagatacaytggagtccttacctctggcacctgtgaatgtgaccttatttggaaataggcttttgcagatgtaatcaagttaagaatgatgtcataatgcattaggattaagtctaagtccaatcactggagtcattaaagaagggggattagacaaagacacacaaggagaagatggccatgtgatggcagaggcagaggttgggtgatgccaaggaatgtcaaggtttgctggcaaacaccagaaactagaaggagcaagtcaggattctcccctggaggtttcagagagagaatagccctgcgaaa

SEQ ID NO: 80145 - DNA, 601 bp, Human
ttgcagcataagattttagaaaaatgtaaaaaacaaaaaatctttataactcttggttgttatgttcactgagttggcaatgtaattttgcagaagcattgccttccaagagctgtgaccacaagatgttaaataacagggactcctccggtttctaaagccctgatcagccttgatactgtaggagtctgcaaatctgtccagttctgtaagagtcctgtgcattgttacagaaattgataaggaaggcggggatcttgtcccatgcacccagactaatagggctccagaatgttgtagkgtttgccttatgggccctacacagagcagaattccctcacaaagaaggcctctggatctagcacatctgtgtaggcaaaatgtttatccaggtaagggtaactaggcccttcaattcagctctccaagagtacacaggcaagagtttttttctaaagaccctggtagctcaaaaccagcactatcaaggctaatcacattatacttcctatgggaatgctgaattcaacaatctgaaggtagtcaagaaactcatccagtataggctacagatgtctagggaaaagagagagtgagtcca

SEQ ID NO: 80146 - DNA, 601 bp, Human
aaaatgtaaaaaacaaaaaatctttataactcttggttgttatgttcactgagttggcaatgtaattttgcagaagcattgccttccaagagctgtgaccacaagatgttaaataacagggactcctccggtttctaaagccctgatcagccttgatactgtaggagtctgcaaatctgtccagttctgtaagagtcctgtgcattgttacagaaattgataaggaaggcggggatcttgtcccatgcacccagactaatagggctccagaatgttgtagtgtttgccttatgggccctayacagagcagaattccctcacaaagaaggcctctggatctagcacatctgtgtaggcaaaatgtttatccaggtaagggtaactaggcccttcaattcagctctccaagagtacacaggcaagagtttttttctaaagaccctggtagctcaaaaccagcactatcaaggctaatcacattatacttcctatgggaatgctgaattcaacaatctgaaggtagtcaagaaactcatccagtataggctacagatgtctagggaaaagagagagtgagtccaagtcaaagcaagggggaaag

SEQ ID NO: 80147 - DNA, 601 bp, Human
gcagggggaatatgcaggaatgatttcagaaatgaagattttattttaatcctcccacaaaagcattcaagtaagctctttctctgtgagaaagctagagagtaagaaacaggaaaggaaggttctcagcgaaaagatccatgtcgacttctaatattgctcacttagagaatacatgccatctgggcatttgataaaaagaaaaaagggcgtagagaaaagctcaaagccatggattctgcttgtgagtgcaaggtgctcgcctttcctcatggccagctctttcctttgttggaggcctttttttttttttttttcctggtcagcaatgactttttcaaagtgacctgtcaagtcttcctttctttattccctgtggccaaggagccaagcagtgggcaaagaggagagaagaggagaggacccaggtgacaagggcaaggctggtattttattcattaattgtctgagtgttatctataaaatgcgaactcacagcccacttgtgcctgaggctgaccccagcatactcacaacttgctactccaagccagagaggacaagaatacctgccttgtcttcatagattttcatactgtct

SEQ ID NO: 80148 - DNA, 601 bp, Human
tgataaaaagaaaaaagggcgtagagaaaagctcaaagccatggattctgcttgtgagtgcaaggtgctcgcctttcctcatggccagctctttcctttgttggaggcctttttttttttttttttcctggtcagcaatgactttttcaaagtgacctgtcaagtcttcctttctttattccctgtggccaaggagccaagcagtgggcaaagaggagagaagaggagaggacccaggtgacaagggcaaggctggtattttattcattaattgtctgagtgttatctataaaatgcgaaytcacagcccacttgtgcctgaggctgaccccagcatactcacaacttgctactccaagccagagaggacaagaatacctgccttgtcttcatagattttcatactgtctcttagaggtgcatgttttgggcacaaaatccagggctttctggcccatgacttagtcaggagtggtcatgggtctctcactttagccctgtcattttgaaaaccttttcctttggaaaggaatttggcccgttccagggactattgaagacaacagaaaaccaaagagctaagcaattaagtttatgtgct

SEQ ID NO: 80149 - DNA, 601 bp, Human
ctttaatctaaaatatagttatgtgccatataatgatgttttggtcagcgacaaaccacatatacaatgctgctcccatattatattactgtatttttactataccttttctgtgtttagatatgttcagatacacaaatattattgtgttacaattaccaacagtattcttcatagtaccatgctatacaggtttgtagcctaggtgtgtagtgagctatcccatttaggttagagcacatacactctaagatatttgcacaacaacgaaatcatctaacaacacgtttctcagaatgtrtctccattgttaagcaatgcatgactggatttccactgattttctttgccttttatgacattgacttgtttaagaatacaagtcaccttttttcattaataagacattcctcatttggcatattttctgatatttctcataattagattcagattctacattcttggctataatcctacataaatgttgtgtccttcctaggctattatattttgaaacacctgatgtccatctgttccttattggtattattacttttgatcacctggtcaaggttttgtccaatttctccaatgtata

SEQ ID NO: 80150 - DNA, 601 bp, Human
taggatgccctgcccccacctccacctgtcctcgtttcacccaccctttgccacaggcagtaaaatacagccctgaagggcccagaaagatgcaaggcgtaatccaaaagatgtatctcccaatccttgggagatactaaaatattcctgtaggatgcagaacctccagggtcaacaaggcccgatgggaaggcttttgcttgccactgacagatgtcacagagcttaggcccttccctgggcttctcctgacttgtggttaaggattctcttctgagccatctgagttcctgtgatgccrtcaaaatgagtaagttctctaaccttgggagaccatggcattagagaaaatggaaattgtttgcgaggctcgcagttcattagcctcatataaaatgaatttggaaccctctgaaaagaggagtttgggggcttcagctgaaggtactgctatgactctcaagattccataaaactctggaactgaagccccacagttcttggcagagctttcagactgtggcaagtttaggaaggccacacctcaggtgagtggggatgatgatagtggccaccaagagccacagggaaagggtccagt

SEQ ID NO: 80151 - DNA, 601 bp, Human
tgcccctggagatctgagatatcaaggagaatggtcagtgtagaatggggcaggagcccgggtactcagggagcagtatggctgcccccaggcagctgggttcttcacagtaggaagagacctttcagtttctgctcttccaaccctgaattcgactctttccctgtggctctgcacggctgtgataaccagccccattcacctacttttggccttcaaaaccttctactttcttcccctacacctgggggaggaataatcccagaacatgcaggagaaggggcttattggtccaacttgraaggttgttggcctatctgaagaaagaaatctctagaatgccatattttttaaatgttattatggctttatttaaaaaccgatccatcattttcttaacacagtcattaagaaaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtggg

SEQ ID NO: 80152 - DNA, 601 bp, Human
ggaagagacctttcagtttctgctcttccaaccctgaattcgactctttccctgtggctctgcacggctgtgataaccagccccattcacctacttttggccttcaaaaccttctactttcttcccctacacctgggggaggaataatcccagaacatgcaggagaaggggcttattggtccaacttggaaggttgttggcctatctgaagaaagaaatctctagaatgccatattttttaaatgttattatggctttatttaaaaaccgatccatcattttcttaacacagtcattaagraaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtgggggaccagggagacatggattgaaaaatccactattcagtaccatgctcactatttgggtccaatatacccatgtaataatcttacacatgtacacctaaaataaaatcatct

SEQ ID NO: 80153 - DNA, 601 bp, Human
ggaaggttgttggcctatctgaagaaagaaatctctagaatgccatattttttaaatgttattatggctttatttaaaaaccgatccatcattttcttaacacagtcattaagaaaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtgrgggaccagggagacatggattgaaaaatccactattcagtaccatgctcactatttgggtccaatatacccatgtaataatcttacacatgtacacctaaaataaaatcatctaaaataaaatctgaaatttaaaaacaaatgaagtgcttcaaaacatcaaaaaataaaaatatgtttaaagtaaaaagtgagtcttacacatgtacccctaaaatgaaaccatctaaaataaaatctgcaatttaaaaataaacaaaatgcttcataacattaaaaaataaaaatgtgttcaaagtaa

SEQ ID NO: 80154 - DNA, 601 bp, Human
tgaagaaagaaatctctagaatgccatattttttaaatgttattatggctttatttaaaaaccgatccatcattttcttaacacagtcattaagaaaaaaaaaaaagaaatcatgtcctttgcagcaacatagacggagctggatgatatagtcctaagtgaattaatgcaggaaaggaaaaccaaataccacctgttctcacttctaagtgggagcaaaacattgagcacacatgaacacaaagatgagaataatagacactgcagactactgaagggtgggggaccagggagacatggrttgaaaaatccactattcagtaccatgctcactatttgggtccaatatacccatgtaataatcttacacatgtacacctaaaataaaatcatctaaaataaaatctgaaatttaaaaacaaatgaagtgcttcaaaacatcaaaaaataaaaatatgtttaaagtaaaaagtgagtcttacacatgtacccctaaaatgaaaccatctaaaataaaatctgcaatttaaaaataaacaaaatgcttcataacattaaaaaataaaaatgtgttcaaagtaaaaagtgaaactgactcccc

SEQ ID NO: 80155 - DNA, 601 bp, Human
gcagtctgaggggtgacagcgtgggtggggtgggacccttggctgacagttaggaactccatgctctgggaaagtaaaacacaagccaatccttttgtttttcctttgggagatttttatctgccctccatatgcaaggacacacttctccatgtatcttctttccttctttcctgtcatccaatatgaggaaaaggcagcatgggatctggaatgggaggtttcaagagcacccccccactttttaccaggtgtggacccctggtcaccctcctctcctgtccagttcccagtgcctgtwaaaagagactcagaatacttggtttcatccccagtatagaagatacacaggaaggagctgccctcccaatacagcctttgaagcagactctgcccctccttggccatccctcaccaccaccagaggagggcagacagcccagagagcagggctcatgcagggaggcaggtggagcagcgccgtcagcactggcacactctgccagcattagctaacagctcctcatacgcccctctgagataattaagtattattatccctattggcaggtggagacggtaagacagagtgtttaagtga

SEQ ID NO: 80156 - DNA, 601 bp, Human
tccaatatgaggaaaaggcagcatgggatctggaatgggaggtttcaagagcacccccccactttttaccaggtgtggacccctggtcaccctcctctcctgtccagttcccagtgcctgtaaaaagagactcagaatacttggtttcatccccagtatagaagatacacaggaaggagctgccctcccaatacagcctttgaagcagactctgcccctccttggccatccctcaccaccaccagaggagggcagacagcccagagagcagggctcatgcagggaggcaggtggagcagckccgtcagcactggcacactctgccagcattagctaacagctcctcatacgcccctctgagataattaagtattattatccctattggcaggtggagacggtaagacagagtgtttaagtgacttagttgtaactgctgggattgtttgcgggagaaaccatgccaagaaggaagtgcagttcaggaggccagaattgcttaagctatttaatgtgactgattatttttaaatagctgttggagggcgggggcaggaagagagactagaagcatggccagtggacactggtaaggcattca

SEQ ID NO: 80157 - DNA, 601 bp, Human
taagacagagtgtttaagtgacttagttgtaactgctgggattgtttgcgggagaaaccatgccaagaaggaagtgcagttcaggaggccagaattgcttaagctatttaatgtgactgattatttttaaatagctgttggagggcgggggcaggaagagagactagaagcatggccagtggacactggtaaggcattcaaacattgcaatgaaaagaaggaatatacctagtgtgtctcttaaaacgggttgccatagacagtctgtcagctgcttaccccacatgaagaggagaaaaawtaattgaaggccatgataaggacaatagaaaacaccccacagccttcccacagagttgtacagaggtctccaagttggctaagcaggggccagtctccatctgagagccccaaccttctccagagacagagcatccactggaatcagcagccccaccagtagccactcgatgtcagaaggacttgccagctgtattgcctgccgtagcaagtgcagcttcacctcagagcagcaggaagcccatgtagcctccatgcacagggcagggacagaatgggagaagagtctgggtgaccaagg

SEQ ID NO: 80158 - DNA, 601 bp, Human
accccaccatctaggagagcaaagtgtctagagaagctaaagccctttggggtgagtccagttgctctttctccagagcactcacttcaggaacactgatagcaggacccaggcttcagggactaaacaaggagagaacacacctgcaccattattttttatttttattagcaagatctaaattagggtaatttaatttaaatttttaaaataattttggcttttactttagatacacgaggtacatgtgtaggattgttacatgggtgtattggacccaagtagtgagcatagaacccartaagtagtttttcaacccatgcctccctccctccctctcacctctagtagtctgcggtgtctgttgttcccatatttatgtctatgtgtgctccatgtttagctcccatttataagtgagaatgtgtgatatttggttttctgctcctgcactaattcatttaggattctggcctccagctccattcatgttaccacaaaggacatcatttctttcttttctatggctgcatagtattccatggtgtacatgtaccacattttctttattcgacccaccattgatgagcacctaatgttg

SEQ ID NO: 80159 - DNA, 601 bp, Human
ttggcttttactttagatacacgaggtacatgtgtaggattgttacatgggtgtattggacccaagtagtgagcatagaacccagtaagtagtttttcaacccatgcctccctccctccctctcacctctagtagtctgcggtgtctgttgttcccatatttatgtctatgtgtgctccatgtttagctcccatttataagtgagaatgtgtgatatttggttttctgctcctgcactaattcatttaggattctggcctccagctccattcatgttaccacaaaggacatcatttctttsttttctatggctgcatagtattccatggtgtacatgtaccacattttctttattcgacccaccattgatgagcacctaatgttgattccatgtctttgctgtcatgaatagcgaggcgatgaacataggatctgcaccactaaagacctgactaccactgcgggattccctggacagtgtcctcctcagggcagaagggatgctgtttctttgccctttattgtccctggcctggctcagagaggggcctgcttgtcaaatgaatgaaggcagctagttaattatttagcccttgtctct

SEQ ID NO: 80160 - DNA, 601 bp, Human
atagaacccagtaagtagtttttcaacccatgcctccctccctccctctcacctctagtagtctgcggtgtctgttgttcccatatttatgtctatgtgtgctccatgtttagctcccatttataagtgagaatgtgtgatatttggttttctgctcctgcactaattcatttaggattctggcctccagctccattcatgttaccacaaaggacatcatttctttcttttctatggctgcatagtattccatggtgtacatgtaccacattttctttattcgacccaccattgatgagcrcctaatgttgattccatgtctttgctgtcatgaatagcgaggcgatgaacataggatctgcaccactaaagacctgactaccactgcgggattccctggacagtgtcctcctcagggcagaagggatgctgtttctttgccctttattgtccctggcctggctcagagaggggcctgcttgtcaaatgaatgaaggcagctagttaattatttagcccttgtctctccatcctttctttttaattgtaaactcaagaagcactggataataaaaagaaataataatgcctgtatcctggc

SEQ ID NO: 80161 - DNA, 601 bp, Human
tccttagcacggtaataaattacagtgtcaccatcaagattgtggcttctggaaagaaataagcagcagggccagatgaactctttcagaagatgagagactgttttcatgcaaattcctggcatcctggggaactgggaacagcctctttattatatagactcagttgcaattcagcagccagaagccatttccactagctgttagaagctggtgacactcagagcaagataaccttttaggcaaaaacttcttttccttcttagttgttatgagtcttgtctggaaaaatatcactttmctcattagattgaggaaaatgggtcagtgtactttcagagagcttttaagttgagacatttattctaaaatacctttctaatttgacacagaaacacttgcagctcactttagagcagtgcagtagacagtgactgtggaacaggagcaggggtgtgccacatggatgccccctgagggcaggcccatctgtgtgtgaacttgtctacaatggattgcacagaccctcactcgcaagcaggtgctgtacccaggctggtcaaccacacagtcaggagggtcactgctcgaaggcagagtg

SEQ ID NO: 80162 - DNA, 601 bp, Human
ctggtgacactcagagcaagataaccttttaggcaaaaacttcttttccttcttagttgttatgagtcttgtctggaaaaatatcactttactcattagattgaggaaaatgggtcagtgtactttcagagagcttttaagttgagacatttattctaaaatacctttctaatttgacacagaaacacttgcagctcactttagagcagtgcagtagacagtgactgtggaacaggagcaggggtgtgccacatggatgccccctgagggcaggcccatctgtgtgtgaacttgtctacartggattgcacagaccctcactcgcaagcaggtgctgtacccaggctggtcaaccacacagtcaggagggtcactgctcgaaggcagagtgtccaacctgccaactccagggtgactcttgacatacaatgtaaactttatctcaatttgccctccatttcctttgggccacagatatacttgacagaaacattaatgaggccaatttgctgcttttttcctttttcatcattttaagatcttttgaggcttagtacaatgttgaaaaatatttgctgtattagtctgttctcatgctgct

SEQ ID NO: 80163 - DNA, 601 bp, Human
ctacccctgcagcaaacttctgcctggacatgcaggcatttccatacatcctctgaaatctaggcagagatccccaaacctcaattcttgtcttccgcacactcacaggaccaacatcatgtggaagctgccaaggcttgggacttgcaccctctgaagcaatggcctgagctgtaccttgaccccttttggccatagctggagcagctgagatacagttctgcagttccaaggctccacacagtagggggaacctggacctggcccaggaaaccatttttccctcctaggcctccaggtmtgtgatgggagagactgtggtgaaggtctctgacatgccctggagactcagctccttattagttatgaaaatttctacagccgcttaaatttctccccagaagatgggtttttctttcctatctcattgtcaggctgcaaattttccaaacttttatgttctcttcctcttgaatactttgccgcttagaaatttcttctgccagattccccaaataatctctctcaagttcaaatttccacagacctctagggcaggggcaaaaagctgccagtctccttgctaaagcacagcaaaagt

SEQ ID NO: 80164 - DNA, 601 bp, Human
caaacttctgcctggacatgcaggcatttccatacatcctctgaaatctaggcagagatccccaaacctcaattcttgtcttccgcacactcacaggaccaacatcatgtggaagctgccaaggcttgggacttgcaccctctgaagcaatggcctgagctgtaccttgaccccttttggccatagctggagcagctgagatacagttctgcagttccaaggctccacacagtagggggaacctggacctggcccaggaaaccatttttccctcctaggcctccaggtctgtgatgggagrgactgtggtgaaggtctctgacatgccctggagactcagctccttattagttatgaaaatttctacagccgcttaaatttctccccagaagatgggtttttctttcctatctcattgtcaggctgcaaattttccaaacttttatgttctcttcctcttgaatactttgccgcttagaaatttcttctgccagattccccaaataatctctctcaagttcaaatttccacagacctctagggcaggggcaaaaagctgccagtctccttgctaaagcacagcaaaagtcacctttgctct

SEQ ID NO: 80165 - DNA, 601 bp, Human
ccttttggccatagctggagcagctgagatacagttctgcagttccaaggctccacacagtagggggaacctggacctggcccaggaaaccatttttccctcctaggcctccaggtctgtgatgggagagactgtggtgaaggtctctgacatgccctggagactcagctccttattagttatgaaaatttctacagccgcttaaatttctccccagaagatgggtttttctttcctatctcattgtcaggctgcaaattttccaaacttttatgttctcttcctcttgaatactttgccrcttagaaatttcttctgccagattccccaaataatctctctcaagttcaaatttccacagacctctagggcaggggcaaaaagctgccagtctccttgctaaagcacagcaaaagtcacctttgctctagttcccaacaagttcttcttctccatctgagaccaccttagcctggacttcgctgtccatattcctatcagcattttggtcaaagccattcaacaagtctctaggaagttccaaacttgcccacatttttgtatcttctcctgagtcctctaaactgttccaacctctgcc

SEQ ID NO: 80166 - DNA, 601 bp, Human
gttccaacctctgcctgttactcagttccaaagtcactaccacattttcaggtatccttatagcagcacctcattctactggtaccaatttactgtattagtctgttctcacactgctaataaagacatacccaagacagggtaatttataaaggaaagaggtttaattgactcacagttcagcatggctgaggagacctcaggaaacttacaatcatggtggaaggggaagcaaacttgtccttcttcacatggtggcaggaaggagaagtgctgagcaaaaggggaaaaagccccttayagaaccatcagatcttgtgagaactcactcactatcatgagaacagcatgagagtaatcaccctcatgattaaattacctcccactgggtccttcatacaataagtggggattaggggaactacaattcaagatgagatttgggtagtaacacagccaaaccatatcacttgccatgcaaacagctgcctacttcctcacccaaggaagacattgctcatcaacacaaatacccctcttctctccatacctggaaggtctagcccagtggttctcaggcttggttgctcattggagtcac

SEQ ID NO: 80167 - DNA, 601 bp, Human
atgccagcagttctcaaagtgggagaaccacactgggaatttgttaggaatgcaaattctcaggccctaccccagaactagtaaattttaaagtctgggttagaaccagttttatgagccctccagtaggttctgatacacattcaaatttgagaaccacttctccagccagtagctgtgactaatggcctgacattcaaatcacctgaagcatcaccaaaaacctaccaatgcttgggcaccactccgagaaattcgaataaattaaaatattcatggctttaaaaacaagcaaacaaayaaactttccccaggtgattccagtaggtaaccaagcttgggaaccactgggctaggccttctgagtaatcaaagaaaatgtgtattggcctagctttcagccggtgttgttgtgcatttacctaggcctggagtggccgtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcgaggggctttgatata

SEQ ID NO: 80168 - DNA, 601 bp, Human
acattcaaatttgagaaccacttctccagccagtagctgtgactaatggcctgacattcaaatcacctgaagcatcaccaaaaacctaccaatgcttgggcaccactccgagaaattcgaataaattaaaatattcatggctttaaaaacaagcaaacaaacaaactttccccaggtgattccagtaggtaaccaagcttgggaaccactgggctaggccttctgagtaatcaaagaaaatgtgtattggcctagctttcagccggtgttgttgtgcatttacctaggcctggagtggccrtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcgaggggctttgatataaagtgttggagctatccctcactcccaagtcctcttgccccctaatagtagcccgtgatggttctgccacctaggaacttaacagtggtattgttaaactagtatctgataaaattgtatatactcaatgtattagttt

SEQ ID NO: 80169 - DNA, 601 bp, Human
gccagtagctgtgactaatggcctgacattcaaatcacctgaagcatcaccaaaaacctaccaatgcttgggcaccactccgagaaattcgaataaattaaaatattcatggctttaaaaacaagcaaacaaacaaactttccccaggtgattccagtaggtaaccaagcttgggaaccactgggctaggccttctgagtaatcaaagaaaatgtgtattggcctagctttcagccggtgttgttgtgcatttacctaggcctggagtggccgtctgagtctggggacactgatggtagartgaggatagaattctccctcaggcaggatgacaaagggcagtgcttcaaggtatgaactgtggccgaggtctgatcaacagcagtgatgaaatgttagaggggccctgtggttaatcgaggggctttgatataaagtgttggagctatccctcactcccaagtcctcttgccccctaatagtagcccgtgatggttctgccacctaggaacttaacagtggtattgttaaactagtatctgataaaattgtatatactcaatgtattagtttctcatggcttctataacaaagtatcaca

SEQ ID NO: 80170 - DNA, 601 bp, Human
aaacaagcaaacaaacaaactttccccaggtgattccagtaggtaaccaagcttgggaaccactgggctaggccttctgagtaatcaaagaaaatgtgtattggcctagctttcagccggtgttgttgtgcatttacctaggcctggagtggccgtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcraggggctttgatataaagtgttggagctatccctcactcccaagtcctcttgccccctaatagtagcccgtgatggttctgccacctaggaacttaacagtggtattgttaaactagtatctgataaaattgtatatactcaatgtattagtttctcatggcttctataacaaagtatcacaaactaaacagctttaaacagaaatttattctatcacagttctggaggctgaaagtctgagatcaaggtgttggcagggtcgttctccctttgaaggctctagggaggatctatcctat

SEQ ID NO: 80171 - DNA, 601 bp, Human
ctagctttcagccggtgttgttgtgcatttacctaggcctggagtggccgtctgagtctggggacactgatggtagagtgaggatagaattctccctcaggcaggatgacaaagggcagtgcttcaaggtatgaactgtggccgaggtctgatcaacagcagtgatgaaatgttagaggggccctgtggttaatcgaggggctttgatataaagtgttggagctatccctcactcccaagtcctcttgccccctaatagtagcccgtgatggttctgccacctaggaacttaacagtggtrttgttaaactagtatctgataaaattgtatatactcaatgtattagtttctcatggcttctataacaaagtatcacaaactaaacagctttaaacagaaatttattctatcacagttctggaggctgaaagtctgagatcaaggtgttggcagggtcgttctccctttgaaggctctagggaggatctatcctatgcctctctcctagttgccatcaattcttgatataacttggtttgtagatgcatcaccccaatctctgcctccatcttcacatggtattctccctggtgtgttgct

SEQ ID NO: 80172 - DNA, 601 bp, Human
tataacaaagtatcacaaactaaacagctttaaacagaaatttattctatcacagttctggaggctgaaagtctgagatcaaggtgttggcagggtcgttctccctttgaaggctctagggaggatctatcctatgcctctctcctagttgccatcaattcttgatataacttggtttgtagatgcatcaccccaatctctgcctccatcttcacatggtattctccctggtgtgttgctgtattttcattcggccttcttataaggatgccagcatgaaatgtagggctcatcctaatcyagtatgatgtcattttaacttgattatatttgcaaaggccctgtttccaaagaagatcacattcacaggtctcacagttaggacttcaacatgtcttttgtggggatataactcaatacacaacattcaataatttattgtttaatgataataagaatatattgtgtggtttaaatttctatcgtgttggactttcacaacaacctcaatatactttatgtattataaaccttttggaatagcaggcattacgaaattcagagccatttcatgatacactcggccatgaacctatcactt

SEQ ID NO: 80173 - DNA, 601 bp, Human
tcaatatactttatgtattataaaccttttggaatagcaggcattacgaaattcagagccatttcatgatacactcggccatgaacctatcacttccaaacttcaaggggatcctctcatgctgcacaacagaaatatttggtgaacaagtccatgaacacaatactcagtattcatgagtggctggatttctgccataatcccattgagattttgtctcacacaagatggtggagaaaagtgctgtagcaatgcccagacacatagaagtgctaccctctgggcttctcaacaataagcrattagcaaaaggaatcagtcatatgcctggactttggcctggaaaacttcatacttgggtgggctctagaaccaaagctatgtgttgtacttctgtaacctcaccgtggcaagacagtgtgctggctggatggtgttagggacatccattgcccattgagagtagggctgaggctcatcattaccatgtccccagcagggtactgaggacagaatgggtgctgcatagatgcttgctgcagactgtctgaagctgagggactaaagtgcctctacaccaagagcttctacctgttggcat

SEQ ID NO: 80174 - DNA, 601 bp, Human
catgctgcacaacagaaatatttggtgaacaagtccatgaacacaatactcagtattcatgagtggctggatttctgccataatcccattgagattttgtctcacacaagatggtggagaaaagtgctgtagcaatgcccagacacatagaagtgctaccctctgggcttctcaacaataagcaattagcaaaaggaatcagtcatatgcctggactttggcctggaaaacttcatacttgggtgggctctagaaccaaagctatgtgttgtacttctgtaacctcaccgtggcaagacastgtgctggctggatggtgttagggacatccattgcccattgagagtagggctgaggctcatcattaccatgtccccagcagggtactgaggacagaatgggtgctgcatagatgcttgctgcagactgtctgaagctgagggactaaagtgcctctacaccaagagcttctacctgttggcatcacacctgctggcaggtgtggatgtgggtcagcagatgaccttgaggatgacagggttaggattaattcgctgccagatatcttctcgtagttcaccaaattctacacacacacaca

SEQ ID NO: 80175 - DNA, 601 bp, Human
taatcccattgagattttgtctcacacaagatggtggagaaaagtgctgtagcaatgcccagacacatagaagtgctaccctctgggcttctcaacaataagcaattagcaaaaggaatcagtcatatgcctggactttggcctggaaaacttcatacttgggtgggctctagaaccaaagctatgtgttgtacttctgtaacctcaccgtggcaagacagtgtgctggctggatggtgttagggacatccattgcccattgagagtagggctgaggctcatcattaccatgtccccagcrgggtactgaggacagaatgggtgctgcatagatgcttgctgcagactgtctgaagctgagggactaaagtgcctctacaccaagagcttctacctgttggcatcacacctgctggcaggtgtggatgtgggtcagcagatgaccttgaggatgacagggttaggattaattcgctgccagatatcttctcgtagttcaccaaattctacacacacacacacacacacacacacacacacacagacagacacaaaatcttaaatttatcgtatatctgagttaagacataatttttctgaa

SEQ ID NO: 80176 - DNA, 601 bp, Human
caattagcaaaaggaatcagtcatatgcctggactttggcctggaaaacttcatacttgggtgggctctagaaccaaagctatgtgttgtacttctgtaacctcaccgtggcaagacagtgtgctggctggatggtgttagggacatccattgcccattgagagtagggctgaggctcatcattaccatgtccccagcagggtactgaggacagaatgggtgctgcatagatgcttgctgcagactgtctgaagctgagggactaaagtgcctctacaccaagagcttctacctgttggcrtcacacctgctggcaggtgtggatgtgggtcagcagatgaccttgaggatgacagggttaggattaattcgctgccagatatcttctcgtagttcaccaaattctacacacacacacacacacacacacacacacacacagacagacacaaaatcttaaatttatcgtatatctgagttaagacataatttttctgaagcagtggttttcaaacatttgaagaattcttggcaacacaactattcaatgcaaagctctgtgtggaaggtgtgtatgaagtcttgaagggaactcagaccc

SEQ ID NO: 80177 - DNA, 601 bp, Human
tgaatcccttaggtaaacaaaactggctaaggtctggcagacaagctgagggccaagcagagagccaatttagaaacttccagtgtgggattggaggcaagaaggagaaacaagcctaagagtggccctgtagaaaagagcatctctagactctggaatcttgacctccactgaagggctggcaggacagccagcatgtagaaagaccacagcactgggaccattcaaccctcatgaagctcagggctatctgcatgctacagagttagggaaacctgccccccagaggtggaatgcaacraaaatggggcagagggcagcatagcatgaccttgtagtggcagggctctccaggaggcatgcttcatcactcttctttccttttgtaccattgcaattccttctgacccaaatgtgttagcttttacattgccagggagcaaagaaaaccataacttgtttctcatgtagccaatctcaggtagttccagtgagttttatgacagttacactctctcctcccacccacctcccctgcagcaacattggaacccacatagagggaaccagggcacatgtggcatatccacatgaggctaga

SEQ ID NO: 80178 - DNA, 601 bp, Human; identical to SEQ ID NO: 30185

SEQ ID NO: 80179 - DNA, 601 bp, Human; identical to SEQ ID NO: 30186

SEQ ID NO: 80180 - DNA, 601 bp, Human; identical to SEQ ID NO: 30187

SEQ ID NO: 80181 - DNA, 601 bp, Human; identical to SEQ ID NO: 30188

SEQ ID NO: 80182 - DNA, 601 bp, Human; identical to SEQ ID NO: 30189

SEQ ID NO: 80183 - DNA, 601 bp, Human; identical to SEQ ID NO: 30190

SEQ ID NO: 80184 - DNA, 601 bp, Human; identical to SEQ ID NO: 30191

SEQ ID NO: 80185 - DNA, 601 bp, Human; identical to SEQ ID NO: 30192

SEQ ID NO: 80186 - DNA, 601 bp, Human; identical to SEQ ID NO: 30193

SEQ ID NO: 80187 - DNA, 601 bp, Human; identical to SEQ ID NO: 30194

SEQ ID NO: 80188 - DNA, 601 bp, Human; identical to SEQ ID NO: 30195

SEQ ID NO: 80189 - DNA, 601 bp, Human; identical to SEQ ID NO: 30196

SEQ ID NO: 80190 - DNA, 601 bp, Human; identical to SEQ ID NO: 30197

SEQ ID NO: 80191 - DNA, 601 bp, Human; identical to SEQ ID NO: 30198

SEQ ID NO: 80192 - DNA, 601 bp, Human; identical to SEQ ID NO: 30199

SEQ ID NO: 80193 - DNA, 601 bp, Human; identical to SEQ ID NO: 30200

SEQ ID NO: 80194 - DNA, 601 bp, Human; identical to SEQ ID NO: 30201

SEQ ID NO: 80195 - DNA, 601 bp, Human; identical to SEQ ID NO: 30202

SEQ ID NO: 80196 - DNA, 601 bp, Human; identical to SEQ ID NO: 30203

SEQ ID NO: 80197 - DNA, 601 bp, Human; identical to SEQ ID NO: 30204

SEQ ID NO: 80198 - DNA, 601 bp, Human; identical to SEQ ID NO: 30205

SEQ ID NO: 80199 - DNA, 601 bp, Human; identical to SEQ ID NO: 30206

SEQ ID NO: 80200 - DNA, 601 bp, Human
gggccatcacgccacctgaggccagccaatgggaacgcggcaagctctataaaagcgagcaatccgctgaggtctgggcagaggacgccgcggggccaacagtttcggattcatggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatmcgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctaggagggctatctcgccacctgagaggttgcgcaacgttcaccccaaaggctcttttaagagccacccacctggtcgaag

SEQ ID NO: 80201 - DNA, 601 bp, Human; identical to SEQ ID NO: 34742

SEQ ID NO: 80202 - DNA, 601 bp, Human; identical to SEQ ID NO: 34743

SEQ ID NO: 80203 - DNA, 601 bp, Human; identical to SEQ ID NO: 34744

SEQ ID NO: 80204 - DNA, 601 bp, Human; identical to SEQ ID NO: 34745

SEQ ID NO: 80205 - DNA, 601 bp, Human; identical to SEQ ID NO: 34746

SEQ ID NO: 80206 - DNA, 601 bp, Human; identical to SEQ ID NO: 34747

SEQ ID NO: 80207 - DNA, 601 bp, Human; identical to SEQ ID NO: 34748

SEQ ID NO: 80208 - DNA, 601 bp, Human; identical to SEQ ID NO: 34749

SEQ ID NO: 80209 - DNA, 601 bp, Human; identical to SEQ ID NO: 34750

SEQ ID NO: 80210 - DNA, 601 bp, Human; identical to SEQ ID NO: 34751

SEQ ID NO: 80211 - DNA, 601 bp, Human; identical to SEQ ID NO: 34752

SEQ ID NO: 80212 - DNA, 601 bp, Human; identical to SEQ ID NO: 34753

SEQ ID NO: 80213 - DNA, 601 bp, Human; identical to SEQ ID NO: 34754

SEQ ID NO: 80214 - DNA, 601 bp, Human; identical to SEQ ID NO: 34755

SEQ ID NO: 80215 - DNA, 601 bp, Human; identical to SEQ ID NO: 34756

SEQ ID NO: 80216 - DNA, 601 bp, Human; identical to SEQ ID NO: 34757

SEQ ID NO: 80217 - DNA, 601 bp, Human; identical to SEQ ID NO: 34758

SEQ ID NO: 80218 - DNA, 601 bp, Human; identical to SEQ ID NO: 34759

SEQ ID NO: 80219 - DNA, 601 bp, Human; identical to SEQ ID NO: 34760

SEQ ID NO: 80220 - DNA, 601 bp, Human; identical to SEQ ID NO: 34761

SEQ ID NO: 80221 - DNA, 601 bp, Human; identical to SEQ ID NO: 34762

SEQ ID NO: 80222 - DNA, 601 bp, Human; identical to SEQ ID NO: 34763

SEQ ID NO: 80223 - DNA, 601 bp, Human; identical to SEQ ID NO: 34764

SEQ ID NO: 80224 - DNA, 601 bp, Human; identical to SEQ ID NO: 34765

SEQ ID NO: 80225 - DNA, 601 bp, Human; identical to SEQ ID NO: 34766

SEQ ID NO: 80226 - DNA, 601 bp, Human; identical to SEQ ID NO: 34767

SEQ ID NO: 80227 - DNA, 601 bp, Human; identical to SEQ ID NO: 34768

SEQ ID NO: 80228 - DNA, 601 bp, Human; identical to SEQ ID NO: 34769

SEQ ID NO: 80229 - DNA, 601 bp, Human; identical to SEQ ID NO: 34770

SEQ ID NO: 80230 - DNA, 601 bp, Human; identical to SEQ ID NO: 34771

SEQ ID NO: 80231 - DNA, 601 bp, Human; identical to SEQ ID NO: 34772

SEQ ID NO: 80232 - DNA, 601 bp, Human; identical to SEQ ID NO: 34773

SEQ ID NO: 80233 - DNA, 601 bp, Human
atttctgggcagccttatttcaatagttagtttcactggcttagaaagtgttaaagtcctatttatatgtaattcatgagcataaatcaaggctatgtaaacattacaatgaaaataagtgtattacctagtcttcataaatcagattggcattcaacagatattattgaggccctagtcagtgtcaaccattttcaatgttatttcaatcaatcctctcaacaaccctaagaaatgggtattgtgttcatttgacagacaagggaatggagaaacttgaagaaattaggtgatttcccakgaattacatttgatttggtcttctgctctaagaccagtgttgtcccactattccaaatttattccctcaaaaaaagtgaatacagaaaagctgacatttttacaaagggctttcttacaaatgatcaccagtgatcctgtttagcttgactctagttcagcacattcaagggacatatgtagagtaagtgctccatccacccagtaccaccactttcctttctaagtttgcattttctcagaagcagactctgtgtgtaatttatttgagaggtgaccccaggaagttctggtagagaag

SEQ ID NO: 80234 - DNA, 601 bp, Human
tatatatatatatatatatatatatatatatatatatatacatacacacacacacatacagtatagcatttcaaacaatgaatatatgtctatatgcatatgtataaacatataaaactataagtttatatagggtgtatatatatacatattatatatatacatatatataaaaacatataaaacattccacagaatacagataagagagaaactgagtccacatgagagaatcagggaaaactgaatacagtggatgacacttatagtgttcttatggagcaaatgtgagcccacctgmtataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctgtgttctt

SEQ ID NO: 80235 - DNA, 601 bp, Human
ccacctgctataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctstgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaaca

SEQ ID NO: 80236 - DNA, 601 bp, Human
agtttggacttggttctgacaacaatagcgagcaaacaggccattgcaggctctgtgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtaygttctgcttggtttctggatatcacatttattagttatctattgctatgcaacagaatacttcaaaatttagtggcttacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaag

SEQ ID NO: 80237 - DNA, 601 bp, Human
aattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaacagaatacttcaaaatttagtggcttacaatgagataccatctcacaccagttagaatggcaatcmttaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaaggattataaatcatgctgctataaagacacatgcacacgtatgtttattgcagcactattcacaatagcaaagacttggaagcaagccaaatgtccaacaatgatagactggattaaga

SEQ ID NO: 80238 - DNA, 601 bp, Human
tttcgacagaactataatactaagatgcttttgtgactgagaaaggaattccttacagcagataagaaatcttaatttattaacaaagttaataaatttttgatggcccaagtgttagtcattaacatttgggggagttttataagtaacactttatacgacatcaaaaacaatgatttgggagaaattaatacacctcagatttctcagtttcaccttttcacctgaaagcaggcatgtgaaagcaataaagattgagaaaatgaggatttctctggagagttgtggtaatgtcaaacastatatgaattttatcttctggtaactgtctcctgttagttaaccccaggcagtattctttgcaatcccaagtaattgactttgactggtacatatgaagtaggtttgaccacctgtaccaaggactcgtggctggtttctgattaggctttttaaaaatatcagatttcaacaaatttctatttggttttgtgtgatttcacatctaactgtttcagaaatattgttggagcttagtgagctcaccctacttctaaggaggctgttttgtgtattacaaaattcttgatatttccaactg

SEQ ID NO: 80239 - DNA, 601 bp, Human
gaactataatactaagatgcttttgtgactgagaaaggaattccttacagcagataagaaatcttaatttattaacaaagttaataaatttttgatggcccaagtgttagtcattaacatttgggggagttttataagtaacactttatacgacatcaaaaacaatgatttgggagaaattaatacacctcagatttctcagtttcaccttttcacctgaaagcaggcatgtgaaagcaataaagattgagaaaatgaggatttctctggagagttgtggtaatgtcaaacagtatatgarttttatcttctggtaactgtctcctgttagttaaccccaggcagtattctttgcaatcccaagtaattgactttgactggtacatatgaagtaggtttgaccacctgtaccaaggactcgtggctggtttctgattaggctttttaaaaatatcagatttcaacaaatttctatttggttttgtgtgatttcacatctaactgtttcagaaatattgttggagcttagtgagctcaccctacttctaaggaggctgttttgtgtattacaaaattcttgatatttccaactgcttgaaat

SEQ ID NO: 80240 - DNA, 601 bp, Human
tttcccaagcaaggttagttcctctctccattctgctcccccaggcatcagcttcatgttgttaaaggaagaggtaaaagcagattgtagtactttgtcaaggtttctcacagatgtgtatggttaagaaatggacttactgtttatctatgtggaaggggtttttcaccaaggtatggggatagttgtttttaccaacaaatttcaatcttgttttcaaatcttaaaaacatcaaaacaaataacccagttaaaaaatgggcaaaggacctgaatagacatttatccaaagaagatatayaaatggtctataaacacatgaaagacacttaatagagaaatgcacatcaaaacaagatgctacttctcaagcattaggatgtctagagtttttaaaaatgaacaataacaagtgctggtgaggatgtggagaaattggaactctcatatattgctgatgggaaagtaaaatgatatagccatgttggaaaacagtcgggcagttcttcagaaagttaaatatacaactataatatgtcttagtcagttcaggctgctataacaaattaccataggttgggtggcttataaacaatagaaa

SEQ ID NO: 80241 - DNA, 601 bp, Human
taatgaaagaaaagtttaccttccaggggacatttggcaatgtctggagacattttcgtttgtcagaactagaggggtgtgtgctactggcaactgtagataaagaccattgttaaatatcctacaatgcacaggacacctcccaacaacaaacaatgatctggcccaaaatatcagttgtgtagaagttgagaaaccctattctaaatgtttgagtgacttatgaatccctaaaattaattccattaaaaaatgaaaaaaagttctcttcaagaaaaagtaaatgttaaaatcatcctcscatttggtgctctcagtaaatgaaatgtctcagaccatatctttatagctcttaactgagtaatcacatttgtgggagaggcagatcttgagggaaatctacaaggttgtttaacttcccgaccttgacttagatattattaacttgcatgaagttcagttctgtagcagaaagcacatggtaaaatgtgcattcctttgtctgttaaagagcccaggaaacatttttacagtgtatttaatatgtgtaaggaaataatcacagccctccactaaacatacaatgcaagtattttccttc

SEQ ID NO: 80242 - DNA, 601 bp, Human
tcaatgggaacgagccctgggctagaattcccaacacccagctctgctggggatgtgactccactccattggactggagtttcctcctctgtaacataagagggctttgctgaacgagcccttccaactcttaatcatctatagtgtatgttgattccagtctattcaatggttcccaggtgccagtgggataaaagtgcagagctctggtctgggacaaagccacaggattagaaagtgactgaaatagacaaagaactggatagttgctgtgcgtatacagagcagatctgaaaagtgrcactctacaaggttcaaaaacatatactttggacatcttcatgtgccctagttttatagattcttttaaccgtggggaagaaggaaatggttgaaactaattattgaggaaggctggcaaccccaaaattcaggttttcaaaatctaatttagcacttactgcgggttcgttgaaattaaccaggtaattgacatctctggttcttttagtagtagggaagagtttctgttgtcttttctattttctcaatactaacatgtagttctttatctgcagtgcaaggcatcacgggttgttag

SEQ ID NO: 80243 - DNA, 601 bp, Human
gcctttgtcgggggggtgggggggctagaaaagaagggggaggccagatcaggctaggttctttctttttttttttttttttgacagagtcttgctttgtcacccaggctggagtgcagcagcgcaatctcagctcactgcaacttctgcctcctgtgttcaagtgattctcctgcctcagtctcccaagtagctaggattacaggtgcccgccaccacgcctggctaatttttgtatttttagtagagatgtggttttactatgttggccgggctggtctcaaactcctgacctcaggtratccaccctcctcggcctcccaaagtgctgggattacaggctggagccaccatgcctggccagatcatgctagttttaacttggttatgatacctgtactgtattcaggagggaacaaagattatattatgacctctgtgcaaggcgtggcatgatcagagctatgcttttggactattagtttaatgtcgtgtctgacataaagtttgctaggagcagagcctgaaagggggattcttgtacaaatattccattgaaaggtatcttacgagcaatttgcaagggagtgagggagcatgg

SEQ ID NO: 80244 - DNA, 601 bp, Human
accctcctcggcctcccaaagtgctgggattacaggctggagccaccatgcctggccagatcatgctagttttaacttggttatgatacctgtactgtattcaggagggaacaaagattatattatgacctctgtgcaaggcgtggcatgatcagagctatgcttttggactattagtttaatgtcgtgtctgacataaagtttgctaggagcagagcctgaaagggggattcttgtacaaatattccattgaaaggtatcttacgagcaatttgcaagggagtgagggagcatgggaagsggctaggcagagatatggtttcagaagaagtctagcttcagcctgatcccacagggacctctagggggttaattgcaccagagtttgtcctgccaagaaacaaggaactaggctgttagactcctgcatcagtgaggcactggtcacaagctgtggtggggaaagcagggagagggattcagcatcatcttccaagtatctgtgggcaaggtagttcccattagctagatagatagttgttcaatgaatgagttggtggtagaaacagggataggatgttgcaactgagtggtctggaga

SEQ ID NO: 80245 - DNA, 601 bp, Human
tgttgttgttgttgttgttgttttagaaaacaaaaaagcacagagaagaaagtcaccctcgatcttaccacctgaagataaccattagtcgcatttagagcataccctcctaggcttttcttttcctatgtattttttaaaccaattttggaatgatctgtacacagagttttgtaaccttcttttatcacgtaacatcctgtgaacgtcatatgtatatatttcatatatatataattcacatatatataattcatatatatatttcatatatataattcacatatataattcatatatatttcatatatataattcacatatatataattcatatatatatttcatatatataattcacatatatataattcatatatatatatatatttttttaaatcatccagcccaaatgtcatcctgtgaacatctttacttaggattaaatattgtcctccaacttcaccactaagagctgtctgacagggctccctctagaggaatgtgagccaaggcaatttggccagtgcaggggccagccaaaataataatcgacaggaggctgtgctgtcagcttatgtcagcggctgcttgggatagc

SEQ ID NO: 80246 - DNA, 601 bp, Human
aatgagtgtggaatgaaaccccggccatgccaacacagatgtgtgaatacacacggaagctacaagtgcttttgcctcagtggccacatgctcatgccagatgctacgtgtgtgagtaagtttcaacagccaggctgatctcagtcaatgtttaaggcttggcttttgccatttgatgcttggggaaaagctgacttcagtgattttttaaaaaatctctaatattgcccccagctaaaatgttttgtggcacttgtttctttctttcttttccttcctttctttccttctttctttctttcttctttttttttttttttttttttttttgagacagagtctcgctctgtcacccaggctggagtgcagtggtgcaatctgagctcactgcaacttctgcctcctgagttcaagcaattctcctgcctcagcctcccgactagctgggactataggcacatgccaccacgcctggctactttttgtatttttagtagagatgggggtttcttcgtgttggatggggcctctgtcagcctgtgtccttaagtgattttattgagaagaaacccctgaaaaattctctttggacatattacat

SEQ ID NO: 80247 - DNA, 601 bp, Human
ttcactagttgctgtgcagaacccaccataaggctcagtccccccaggagggtttccatattaacccaccctgcatctctacactgagactttcccattcattctggctgggcatttgttgctccctctatattttgccttatctagtctcggctctgtgactggtggtcatatatacaaatgccagatggatttaaccaaaggaaaagtagacacaggcccacccgtccaagaactagcatccggtgacattctctgccttaatagagagtgaaaaatctcaaaaaaagaaaaaaaaaaacatatttccaaaacctagtatgaagggatgtatcaagagtgtagatgcttagtttacccaaggaaatgtctggaaaagatgttttagatgaggaaactggatccaatgtgaattatttggaaatgttagggaaacactgctctaatatattctgtaattagaatacatgatctaaccttctttgtttggtcatttgattgataccttctgagcatgtgggctttaaggtttttttcttaactgaccaagtgttctttattagtccctaaggtgaatgaagcaggtgaattcggcctgatt

SEQ ID NO: 80248 - DNA, 601 bp, Human
atgctagacgtttttttaaacaacctaatcaaatgatataaaatatttggcaaatcaaaatgagtcaagaatcagctgctgctgtgtttctttttaccctattccctttccttaccattcctttcttccccagcattaaaacatataaagccccaaaatcagagccagaggctagccttagttataaataaaaaatatctcattcttcacccccgccctttcccagtggtatttatctacatcagaggtcagccaacttttttctataaagggctagatagtacatattttaagctttgtrggccataaactactttcacaactattcaactccgtcattgtagctcagatgcagtcattgatgttatgtgaatgaatgggcatagtgtgtttcaataaaactttataaaacagacagtgggccaggatctacataaaagtaaccacaggcactggttcaaaacttaaaactagctgaatgaactcttatatttctctgacacatctaaacaaggcagtcattaacagtttagaggccaggcacggtggctcacacctggaataccagcattttgggaggccaaggcaggtggatcgtttg

SEQ ID NO: 80249 - DNA, 601 bp, Human
tgtcacggcttaccttagctaggaaagggaaatcccccaatctcttacacttcctgggtgaggcgatgcccccgcctgcttcagctcgccctccttggactgcacccactgtccaaccagtcccagtgagatgaaccaggtacctcagttggaaatgcagaaatcacccgtcttctgcgtcgatcatgctgggagttgcagactggagctgttcctatttggccatcttccagtttcaatagttctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttca

SEQ ID NO: 80250 - DNA, 601 bp, Human
tcatttttcttgtgcacatagtttctgtgattgcattactaaccttaacttgtgatagcatcaaaatgtattccatgaagcaggttagtaaattaactacaaacaagccataggaacacatgacttcatgagacagccacaactttaatattcttttgaatcaatagatgtaaagcactcctcaagctaactttataaacataaatgttttccattagagtattagtgcgtattttgacaaagattttacttttgcaccatctttaatgaaacatgtttttcatacctaattttatagttwtacttaccatgatggtcaatacaagaggactgtttgttggaataagtattgcagattttaggaagcatgcaacatttaaaagggctcagaaagtggatgatttttggttgtaaaactgggtcgtacattttctttccaaatattgttaaagtgactgaatatttagagataacagtcatctgacatttcaaaaaagaaaaatcttagtaattggggagaggataaataaataaacatatacatatatgtacatatggatagatttagattttccagaaaagaaggaacaagtaccaaaac

SEQ ID NO: 80251 - DNA, 601 bp, Human
cactcctcaagctaactttataaacataaatgttttccattagagtattagtgcgtattttgacaaagattttacttttgcaccatctttaatgaaacatgtttttcatacctaattttatagttatacttaccatgatggtcaatacaagaggactgtttgttggaataagtattgcagattttaggaagcatgcaacatttaaaagggctcagaaagtggatgatttttggttgtaaaactgggtcgtacattttctttccaaatattgttaaagtgactgaatatttagagataacartcatctgacatttcaaaaaagaaaaatcttagtaattggggagaggataaataaataaacatatacatatatgtacatatggatagatttagattttccagaaaagaaggaacaagtaccaaaacagtataaggaaggtaaatcttaaatcattcaacctgttaaagagaaatcttaaagttgagaaatttaataatgatggggaaaatgctgtttactttagtgactatgtatgtgactgtatgtatgtatataaagtgaaaatttgaaaaattatgagataataaaacttgttatctc

SEQ ID NO: 80252 - DNA, 601 bp, Human
aaacttgattccttatactgtagtcagaatcgatttgcatcttctcttatatatccaaagaactttgagtttttaaaatcagattgatggttttgagttagctgttacagcaacatattacaaaattccaacagaacttccttctcaaataaatctcacccatgctcacttctctcacttagccaccctgttctcttccctggaagcaagcaatataaccttttttgagtatccctcctgatatggtttggctctgtatccccacccaaatctcatctcaaattatcatcccatatgttgygggagggacctgtaatccccatgtgtggagggagggaagtgatcagattatgcaagcagtttcccccatgctgttctcctgataatgcatgagttctcacaagatctgatggttttataagtgtttggaagttcctccttcataacacttctctttcctgccaccttgtgaagaaggcacttaatttccctttgccttctgccatgattgtaagtttcctgaggcttcccctgccatagggaactgtgagtaaattaaacctctttcctttataaattacccagtctcaggtatttcctt

SEQ ID NO: 80253 - DNA, 601 bp, Human
tttgcaacatactgaatatttatttactgttcttatttattatctccctcccctacaagaatttaaactcagtgagggcagaggctcttgtttgttttgctcactattgtattgttaatacttagaagggagcctggtacatagaagatgctcaataaacattttctgaattcttataagaatgaacactaagtgcctctgccttcatcatacaatgtcagtgttccaaagaccaccaggagcacacctgcagttaaattagtttactttatcagttattgtgggaagggagggtgcacaycatgggaagccatggggtgtctcagtaagagggtattaggaggaaactatcatatgatttaggttttggctgagtgacttggtgaagagtctaagaaggcagggattttctctagattagatgttgtcagaaagcagaggcgttcctgtgattgggtaaagaatagcagtcattcattcagcaagagagagggatgtttggtattttgtgggttgcacagtgaccttcttttctgatcttagacaatatttaaaagtggcctggctttgtctcattttattatggtctgagagtaaactt

SEQ ID NO: 80254 - DNA, 601 bp, Human
agttttgagtaccacaatttttcttactcataaaattagattcccttgaaaatactattctcttcaaatcataatttagagctacagtatgatatatttcatgctactaagtggggtaatcttattcagctttgtgcatggaggagtatattcaataaatgaaaatatctacctctatagctcctaaatactggtgttttgtgtttatccatttacttaggccttcttaaatgtctttggaggaagttttgtgaattacttaaaatttttttacagcagtgtccaaggcctgagaaatacyatgaggtttggctggtgacacctggtggttagacgtgataattacacacaacatgtagcacaggctttactacaagccacaaaagcaccttgtattggtccattctcacactgctaatgaaaacattcctgagactgggtaatttataaagaaaaagagagttaatggactcacagatccacatggttggggacccctcacaatcatggcagaaggtgaaggaggagcaaaatcacatcttacatggtggctggcaagagagcatgctcaggggaaccaccctttataaaaccatcagat

SEQ ID NO: 80255 - DNA, 601 bp, Human; identical to SEQ ID NO: 36640

SEQ ID NO: 80256 - DNA, 601 bp, Human; identical to SEQ ID NO: 36641

SEQ ID NO: 80257 - DNA, 601 bp, Human; identical to SEQ ID NO: 36642

SEQ ID NO: 80258 - DNA, 601 bp, Human; identical to SEQ ID NO: 36643

SEQ ID NO: 80259 - DNA, 601 bp, Human; identical to SEQ ID NO: 36644

SEQ ID NO: 80260 - DNA, 601 bp, Human; identical to SEQ ID NO: 36645

SEQ ID NO: 80261 - DNA, 601 bp, Human; identical to SEQ ID NO: 36646

SEQ ID NO: 80262 - DNA, 601 bp, Human; identical to SEQ ID NO: 36647

SEQ ID NO: 80263 - DNA, 601 bp, Human; identical to SEQ ID NO: 36648

SEQ ID NO: 80264 - DNA, 601 bp, Human; identical to SEQ ID NO: 36649

SEQ ID NO: 80265 - DNA, 601 bp, Human; identical to SEQ ID NO: 36650

SEQ ID NO: 80266 - DNA, 601 bp, Human; identical to SEQ ID NO: 36651

SEQ ID NO: 80267 - DNA, 601 bp, Human; identical to SEQ ID NO: 36652

SEQ ID NO: 80268 - DNA, 601 bp, Human
tccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgwttctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctaagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcag

SEQ ID NO: 80269 - DNA, 601 bp, Human
tgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgattctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctmagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaac

SEQ ID NO: 80270 - DNA, 601 bp, Human
tcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattaygttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacac

SEQ ID NO: 80271 - DNA, 601 bp, Human
tttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaayctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtga

SEQ ID NO: 80272 - DNA, 601 bp, Human
cgtgatctcggctcactgcaacctccacctcccgggttcaagcgattctcctgcctcagcctcccgagtagctgagactacaggcacgcgccaccacgcccagctaatttttgtatctttagtagagacgggctttcaccatgttggccaggatggtctcgatgtcttaacgtcgtgatccggccgcctcggcctcccaagtgctgggattacaggcgttagccactgcgcccggccccagccaggcagttttaatcgagcgctcacaaccactgagacgcagtgaagcacccaccataawatcccaggaggccgaccgccggttcagactttttcttttctttaatccccgtccaagggatccgccctcaccccccaccccagccaccccaattccctattccctccccttggacggcgccggggaaaacaagctgctcgagctttatttcttcggtgcaaccaactcagaatgaattcctccgcccctgcgtgctcagtgagtcggcaccctagcagtgaactgcatttaaaacctcaggaattgagcgaactctcccagtggctctcctcaccgggatccccttccacgcctcctccc

SEQ ID NO: 80273 - DNA, 601 bp, Human; identical to SEQ ID NO: 40647

SEQ ID NO: 80274 - DNA, 601 bp, Human; identical to SEQ ID NO: 40648

SEQ ID NO: 80275 - DNA, 601 bp, Human
ggaaggctggctggaaccccacctctccccctgccagctccacccccggccatgctaggatgtgcttccctttgtggggaggatgagagggaggggcccacggtctagctgggtggatagggtgagtgtcccaggaggggacacttggcctggactctggcctcggacgcatgcatggtcttggcagggcctgtgttttccttgcctccaccctctgccatggaggtcacttgttggctgggcaggggtctcagtacccttcgccggctggccgagccaggtagtgggaggtggcggcagmtctggccagctggcagagtccagggctggggcctgccaggccgcttacagtaactctggcccccagggcccagctgggcgccaggccagggctggggggaggagggagccggggcctggcctgggacgggagagggtggaagcagcagaatgggccatgggctgctggctggccggctggtcagctgctgacctgggaaacgtgtccccacctctcctggccagcagggactgcacaccttgccctgtgcacccaccacccctctcacggctgctggcaagctgcctggcaccactgccc

SEQ ID NO: 80276 - DNA, 601 bp, Human
ggaggggacacttggcctggactctggcctcggacgcatgcatggtcttggcagggcctgtgttttccttgcctccaccctctgccatggaggtcacttgttggctgggcaggggtctcagtacccttcgccggctggccgagccaggtagtgggaggtggcggcagctctggccagctggcagagtccagggctggggcctgccaggccgcttacagtaactctggcccccagggcccagctgggcgccaggccagggctggggggaggagggagccggggcctggcctgggacgggagrgggtggaagcagcagaatgggccatgggctgctggctggccggctggtcagctgctgacctgggaaacgtgtccccacctctcctggccagcagggactgcacaccttgccctgtgcacccaccacccctctcacggctgctggcaagctgcctggcaccactgccctatgtgcctggctgggctgggtcagtgcccccttctcagtgtgggggcagcgctctctccccggagccagggagtctctttgtccctggggcaggccctggctgggcgcctcactgcccgcactggctgggtg

SEQ ID NO: 80277 - DNA, 601 bp, Human
gaggcagaggttgcagtaaaccgagatcatgccactgcactccagcctgggggatagagcgagcctctgtctccgaaaaaaaaagataataaaataaaacttaagacactggctgcgtgcagtggcgcctgcctgtaatcccagcacttttggaggctgaggtagggacttcagcccaggaatttgagacaagcctggacaacatagtgagaccctgcctctaccaaagagaagaaattagccaggtgtggtagcgtgtgcctatagtctcagctactcgggaggctgaggtgggaggatcgcatgagcctgagaggttgaggctgcagtgagctatgatcacgccactgcactccagcctggtgggtgacagagcaagaccctgtctcaaaaacaacaacaacttggacatttatgtcacatacaacttgctgataacctctctgagcatgtttcttttttgttgttgtttgttttgagacggagtcctgctctgtcgcccaggctggagtacagtggtgcaatctctcagctcactgaaaccctctgcctccaggttcaagcgattctcttgccacagcctcctgagtagctgggatta

SEQ ID NO: 80278 - DNA, 601 bp, Human
gtaaaagccacagttcttattcttaatttgtttcaatttgtggatggaggcaaagaagttgcaagccatcaacagaggagccggggatgggagccccaaaagggtggctgcatgtttgcttcgtgtgcctagagactggggaatgcccgagggtctgggtgagccccagcagaaggcagaaaggaggaggttgtgtccttcccttcttcctatcctctgccacttcctcgctgttgcagtctgtgcatactgcctccttccctgcttcccactctttccctggacaataggagggacagcycaggcggagggacagcccaggcagagggacagcccaggtggagggagtgctgcctagcaatgcctttcttggagtccgaaatgtagagtcagacaaaagaacatgacatggagtttttaatgaaaatggggtccctcaccttttatctcccagcaaggataatgcacaggttccctctggacaagatcccagcatagacgcggggagggaactcagggaaggaagcccgtcttccttttaggtgggtcagggccgaggtattgtgtctaccccatgccaagggatgtgttgcttatgggg

SEQ ID NO: 80279 - DNA, 601 bp, Human
ccaggcctgcagacagctgccgctggaggccccccagccccagctgcgggccagagccttccttgtttcccacttctcccactgccccaggacactgtgttctgctctgacctgccccatgaccttgctgttgcccagaacgggcctcttgccctagcttctcctctccagctccggaaatcctatctatccttcaaggaacatcttgaatgccgcctcttcccagaaatcttcacagatgttcccccttgcttgccacactctgcctccctacttagaatgcctgtgggtccttatttawtttttaacaacactcatctcgctacccagaagttgcttctcccctgttcctgccatgagctgtaaccatttgggacatcttttcctgaccacaaggtctttgatggcagggacagagtctcaggtcccttagcgccttgcagctgtgagcgcagagccttgctccatcatttgaaagatcccgaaggcatggaagcactctgtcctcttcgccattagtctcatccactgtcaagatttgcatacctgcccccagaccccagcattccatctgtagccctgactgcacttcagggcccca

SEQ ID NO: 80280 - DNA, 601 bp, Human
accatttgggacatcttttcctgaccacaaggtctttgatggcagggacagagtctcaggtcccttagcgccttgcagctgtgagcgcagagccttgctccatcatttgaaagatcccgaaggcatggaagcactctgtcctcttcgccattagtctcatccactgtcaagatttgcatacctgcccccagaccccagcattccatctgtagccctgactgcacttcagggccccacatccacctgtccagcagcccagtggacttctctgctttgcagtctcaggaacttcactgatgcrtaagtcacacacaagtctctttgctacctcttttcccataccccttacccccacccccccacgttatttgtacctttaaaatgtttattgaatccaccttcctctgtccatcagcacttccagtttcctaggccaagccacccttgtctgatgcctggactgctgcagtagcttttacctggtctctcttgccctcctataatccattcttcacacaactactggaaagatctttttacactgtaaatctgatctttcctttgcttggaacctttctatggcttttccttgcatttagga

SEQ ID NO: 80281 - DNA, 601 bp, Human
gcctctccccgggaggaggaaggacggtacagagggccctacgccccctccccaaccatccccaggggctgcgaggggagctgcggaggagcgggcgccagctggattgggaggggagccgctggccgggggcccggctgatttcctgctgatctcctccaggaaaccggccccttgtgcgagcctgcgaacggctcgggggcgtggggaatccggagtggagcgctctgcgccgcccgccctgccaggatggggagcgagggaggggcaccctggcagcgtcggcgggaggggacgcctsgcttcctgggtcagttccagtcctctgttgggcgctggaactttgagctgagaaggtgtggtccttctctagcccgagtccttctgcaggaagaggagagattggtgggctgggcctctggggagggaggttagcagggatgggccaggcccgggcagtccctcccccgttggtgtccctccccactccacctgtgtgtgcagggagttatggccgtgtcctaactcttgcagaggctgtgaggattccggagttccccacacctccggccttggtccttgtacctcacctccttggact

SEQ ID NO: 80282 - DNA, 601 bp, Human
atctccccctatctcagggagacacctcctactgtgcccagcatttgtgactcttctttgcaccccctgccttgggtccctggccctgggattgtttgggtggaggaggggcagtggctgctggcagaatggggtggaggggggagcggaagcagagggggcgggggagtggccggctttgaatatcctgttgaccccagtttcctctgcccccagcttatgtcctcttccctccctcctcttcaagcgttaactccttcctaactcggggggagaacggggccaggccgcccaggggcargagctttagaatcagggtgacccccacccctactccccaagcacagtcacggcacacatacaaatgtgatggtttatcattgtatctttgtggttttgaaggtgggggtcctaggagtccagaggagtgatggggtgctggaggcttcattggcagcctcctgccctgagtctggctggggagtcccagttttcttaagacttgaatcctgccagcagtggtgaggctgggagaggctcttaggagggacggtgaggcagggtggagcttggtactaaggatggcgacctaggtctctaa

SEQ ID NO: 80283 - DNA, 601 bp, Human
tctgtgatgggtcggtgcacacctgtcttggtgaactcacatctttctgccttgctcctgagtgcatgtgtgtgttcgcctccatttctctggccagcccgtgtatctgcctcctggcctcttcgggcttgtcttcttttcctgtgttctgagttcaggggtgtgggttccagatccctggctgttgcccagttagccccatgtcttcctatttctgactcaccagcagccctgaggtcttttccctggaagggaggagtcaggtgtgtgctgtgggttgggggaagactcctgcccatcstgcagtgttgaggcaggtactgggattctcctgaggaggatccttttaggtgaatcattctccccagcttttctggcctgctcaggtaggcgatgggcaaacgcttgggggcagcagctggcctggccctcctcccctagactgagaccgtagccaggcactgctcccactgtgggtgtggacaacctgactccctcccctccatacccagggcttcttccgccgcagcatccagaagaacatggtgtacacgtgtcaccgggacaagaactgcatcatcaacaaggtgacccggaaccg

SEQ ID NO: 80284 - DNA, 601 bp, Human
aagtgggcatgtccaaggagtgtgagtgccatagggcaggggccgagtcccgcctcagttggggtctcagatgctcctaaagaccaagggagcagggctctgtggatgtttgtgcacatgcatgaacacgcatgccgtggtgtgcgggctcacggttgaggatggtttgtgtgtagctgcaaggacctgtttgcgagtctggctggctgtgtgtccacgggcaggtctgtgctccgggaccgtgtatgtgtaaccattcctgtttctgcacgtctggctgtgtgtgcttgcgtatgtgtgygtgtgtgcatgctccaggatggctttcttccaggccgtgcttggttttggggtggggctcagaggcataggcagtcccttctgattgtgagtcttaggggaggggcttgaattctgaggggtgcttggctggacttatgtgtgtatgggggggtggaagggctggcacaaggatccaaaagccattgtctagttaagcctgggattcagagttggaagaaagaattgggacttctcagatcccagaggaaacggggtttccactttgggctcagctgaggcctgatggagggagggaggg

SEQ ID NO: 80285 - DNA, 601 bp, Human
cagtagacgcatgtggctggtggctgaggtatggatggtgcagacgtagaacctttccatcattgtagaaaattctatcagacagcattgctccggccacctgccaggtggtcctccgggagtgctggtgcggagtgctggtgccgagtgctcagagtgggttcgggttcagtccctgaacccaagcatcctctgcacccagatcctgcggatctgcacgcggtacacgcccgagcaggacaccatgaccttctcggacgggctgaccctgaaccggacccagatgcacaacgctggcttyggccccctcaccgacctggtctttgccttcgccaaccagctgctgcccctggagatggatgatgcggagacggggctgctcagcgccatctgcctcatctgcggaggtgggcagggggcctgggtctgggggctgggctgggacgggggtgcagccctggagtctcttccagggagctctttcaggccacctctgttaggtatctctagagggcagggtctggtctgcaactacacagcaagggggccatgtggggcctggactcctgttcccgatttctgggcaacaccccttctaggg

SEQ ID NO: 80286 - DNA, 488 bp, Human
tgtccttgtgtgggtcactcaacagctcctagctacagtttcccttccgagggcggggataacattcgtgtttacagaggggtcgggatgatccctagcacacagcacaggggaaggaagggcttggcgtctagcccaggccggcagtctggccctggagccggagttcgggaccactttgccccattgccaccagcctctggacctgggggcttaagagagctggctcgtgtcaaagaactgaatcccaagaaagatgctaatatcagcagtattgatcttcccacctcgagccaggctygctggggctgggggtgggagggctggcccagcgtgctgacctctgccccctcctttcctgcaggggctgagcgggtgatcacgctgaagatggagatcccgggctccatgccgcctctcatccaggaaatgttggagaactcagagggcctggacactctgagcggacagcggggggtgggggggcg

SEQ ID NO: 80287 - DNA, 601 bp, Human
ggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccytcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatgagcttggacttcttgtctgtgttgtggagggcgagtgggtggggagtagtcacactggtatgccctcc

SEQ ID NO: 80288 - DNA, 601 bp, Human; identical to SEQ ID NO: 38697

SEQ ID NO: 80289 - DNA, 601 bp, Human; identical to SEQ ID NO: 38698

SEQ ID NO: 80290 - DNA, 601 bp, Human; identical to SEQ ID NO: 38699

SEQ ID NO: 80291 - DNA, 601 bp, Human; identical to SEQ ID NO: 38700

SEQ ID NO: 80292 - DNA, 601 bp, Human; identical to SEQ ID NO: 38701

SEQ ID NO: 80293 - DNA, 601 bp, Human; identical to SEQ ID NO: 38702

SEQ ID NO: 80294 - DNA, 601 bp, Human
attcaagggtgtgaaccaattgcagccagggccatgttttgactatctcagcatacctagatcacagtacagggaacatagctggtgttcaataaaagctttgaatatgcgagtatatatcacctttaatagtttcttctctgttttttctttttcctgatttcagacatccacattccaccctgggccttgcccgtctggtgagcccaatctctgctggtcagtcacgcagttgaggtcagggaaggtatgttgggatgggctgacatgaggggtaatgagggtcaagatgaaagttaargctagggacattcttttgtgtgtgcatagtttaaaagacaaatcagtcattttgcatgttgatatctataaatgaccacatcaacatatctgctttaaagtggccgtgtcccagtggcttcttctaccactgtcacttttgaaggagggtcctgttccactccttcatcactatagtgacctctattaaacaaaagaggtaccaggaatcaaacattacatttcagatgtgaaatatctcccaataaaccagcattcactacttccactgggaattctctgtggctagaaaactattttt

SEQ ID NO: 80295 - DNA, 601 bp, Human
tgttttgactatctcagcatacctagatcacagtacagggaacatagctggtgttcaataaaagctttgaatatgcgagtatatatcacctttaatagtttcttctctgttttttctttttcctgatttcagacatccacattccaccctgggccttgcccgtctggtgagcccaatctctgctggtcagtcacgcagttgaggtcagggaaggtatgttgggatgggctgacatgaggggtaatgagggtcaagatgaaagttaaggctagggacattcttttgtgtgtgcatagtttataagacaaatcagtcattttgcatgttgatatctataaatgaccacatcaacatatctgctttaaagtggccgtgtcccagtggcttcttctaccactgtcacttttgaaggagggtcctgttccactccttcatcactatagtgacctctattaaacaaaagaggtaccaggaatcaaacattacatttcagatgtgaaatatctcccaataaaccagcattcactacttccactgggaattctctgtggctagaaaactatttttgttgaatctttgccttgattttctgggaaagata

SEQ ID NO: 80296 - DNA, 601 bp, Human
cagtacagggaacatagctggtgttcaataaaagctttgaatatgcgagtatatatcacctttaatagtttcttctctgttttttctttttcctgatttcagacatccacattccaccctgggccttgcccgtctggtgagcccaatctctgctggtcagtcacgcagttgaggtcagggaaggtatgttgggatgggctgacatgaggggtaatgagggtcaagatgaaagttaaggctagggacattcttttgtgtgtgcatagtttaaaagacaaatcagtcattttgcatgttgatmtctataaatgaccacatcaacatatctgctttaaagtggccgtgtcccagtggcttcttctaccactgtcacttttgaaggagggtcctgttccactccttcatcactatagtgacctctattaaacaaaagaggtaccaggaatcaaacattacatttcagatgtgaaatatctcccaataaaccagcattcactacttccactgggaattctctgtggctagaaaactatttttgttgaatctttgccttgattttctgggaaagatatatttttaaccccattcaccttcctccctc

SEQ ID NO: 80297 - DNA, 601 bp, Human
ttctcatggctttttttccccaacatgtattatcctgtgaccctgaataaatatcccaaactagttaagattcaattctttatctttaaaaaggggataatattgatcccttgttctcagggtaactgggagaattaaacatatttcatgggcataaaatgcctggcatgtaagaagtgtttctctctggctgataattgttatctgattatcctctctcagtttggaggtcctaaaccccagctccatatctggatctgttacttttttttgccatacctatttgatgcagacttcttasctacataaatatctacatactgcctattatcccttttcctaacttccccaacactgggttttcccctctttctcttccccctgttctctcactgggggcctgttaagctgattaaataagccctgcccctctttactccctgttccagcagctcaactgaatttccgtcctttcacagtcatagctggatgcgtcccaagaacagaaaatgccacactccagtgggcaatcctaaactcttggctttcgaccttagaagtctggccactacattgcctttgaatccacatgtgtcagatc

SEQ ID NO: 80298 - DNA, 601 bp, Human
ctttatctttaaaaaggggataatattgatcccttgttctcagggtaactgggagaattaaacatatttcatgggcataaaatgcctggcatgtaagaagtgtttctctctggctgataattgttatctgattatcctctctcagtttggaggtcctaaaccccagctccatatctggatctgttacttttttttgccatacctatttgatgcagacttcttagctacataaatatctacatactgcctattatcccttttcctaacttccccaacactgggttttcccctctttctcttccccctgttctctcactgggggcctgttaagctgattaaataagccctgcccctctttactccctgttccagcagctcaactgaatttccgtcctttcacagtcatagctggatgcgtcccaagaacagaaaatgccacactccagtgggcaatcctaaactcttggctttcgaccttagaagtctggccactacattgcctttgaatccacatgtgtcagatctaataatacttagttgaagatttactatcttctccctaaataactgctccctgccactgggatgatcctctcagctc

SEQ ID NO: 80299 - DNA, 601 bp, Human
tggccactacattgcctttgaatccacatgtgtcagatctaataatacttagttgaagatttactatcttctccctaaataactgctccctgccactgggatgatcctctcagctcccagccccacaatctgctagcatggagctgtgaaagctgtattccatcagcaaggatctcccaaggctaaaagacccagaaacctggccatctgcacctacaatgtcaggagatataccctcttcaaaggggaaggcactgcttctacttaaacagttctccattgtgatgacaatacatacttyaatcctgtaaagtttctccagacacgaagatggaaatgtgcttttctgcttcccagtctcaggcattcttttatctctaatttgacatgacaaacagactctccatcgtcacctgttatggtgtgaatgtctcttcatttcattaatgcagggctgccactgacataaagggtttttttgttttgggtcactcttctgtacccctatccttcccatatctaataatcaccattattatattaaaaggcaaatgttctgatcacagcttgatagtgtccttgaagtgaacaggacgatttt

SEQ ID NO: 80300 - DNA, 601 bp, Human
ctcagctcccagccccacaatctgctagcatggagctgtgaaagctgtattccatcagcaaggatctcccaaggctaaaagacccagaaacctggccatctgcacctacaatgtcaggagatataccctcttcaaaggggaaggcactgcttctacttaaacagttctccattgtgatgacaatacatactttaatcctgtaaagtttctccagacacgaagatggaaatgtgcttttctgcttcccagtctcaggcattcttttatctctaatttgacatgacaaacagactctccatcrtcacctgttatggtgtgaatgtctcttcatttcattaatgcagggctgccactgacataaagggtttttttgttttgggtcactcttctgtacccctatccttcccatatctaataatcaccattattatattaaaaggcaaatgttctgatcacagcttgatagtgtccttgaagtgaacaggacgattttctgtctacccagtgaaaacagcctttggtccttcacagtgatttcacagacaacctagagcctacgaggagactggaatgttgatctctctcaggtcaggaaccagac

SEQ ID NO: 80301 - DNA, 601 bp, Human
ggtcactcttctgtacccctatccttcccatatctaataatcaccattattatattaaaaggcaaatgttctgatcacagcttgatagtgtccttgaagtgaacaggacgattttctgtctacccagtgaaaacagcctttggtccttcacagtgatttcacagacaacctagagcctacgaggagactggaatgttgatctctctcaggtcaggaaccagacttacacacctacacacttcgtgcgcgcacacacacacacacacacacacaaactcatttccggcatccagtctttatratgagagctagttcttcagtaagagtccagcttctggctgcagaaggaattaatgccaagataatcctgtgtactttggatccacgcagtaggaagcttcatgcttgctgctttcctcaggatgccctgtgacatcacccacactggattgtttttccttttgtgttaaaacactttggcttcattccaaagggtgtctgaagacaacaagccttccctccagtctacccactggccacgtaatcccacaactggaaacattcttctgcatgaaaaggcatcactcaattagctctcact

SEQ ID NO: 80302 - DNA, 601 bp, Human
cagtaagagtccagcttctggctgcagaaggaattaatgccaagataatcctgtgtactttggatccacgcagtaggaagcttcatgcttgctgctttcctcaggatgccctgtgacatcacccacactggattgtttttccttttgtgttaaaacactttggcttcattccaaagggtgtctgaagacaacaagccttccctccagtctacccactggccacgtaatcccacaactggaaacattcttctgcatgaaaaggcatcactcaattagctctcactcagagcacccctcccaygtctcagcttcctttgacctctttccttgccgatgttttagattcttaatggtttggtctggtggaggtctgctacagtcacttgatacttgtacttgtgtcccccagtgtgtatatcaagggctgatattataaggagagtgagtagatgcatctcaggaaaaattaaaaatcacttcagatgctgaaatagttcactacaaccctggtgtctggagttgcagggaataggatataatctcctcaattctagaaaacatggttcaagctgtatacaaaagatatacacatctgagggta

SEQ ID NO: 80303 - DNA, 601 bp, Human
atctcaatgtgttgctttcatacaaagaacattctttgattcaaatgagaagaatatacatcagagtggtcctgctcaggagaggaagtggagaccccctttgcttgatggcacagcatagatgatgtgttgccacactcaggtgcccctgggaccaagaacccgagaaccaagtatgagtcctggagggctaggggttgatgggcagggccttgcactccttttggttttcacaaggttttagcgacatttggccaaatatgaataacaggacaaatattccttcagcctattatgtctyctctcgtaaatgtttctggataagggagctggcatgggcatattcacaagttgttgacaatctgtctttgaggactggtttctaattttttttttttttaatgagggcatccagtctatgtttctaggggaaaattacatgagatttgggagttcaaatgccaatgatgtttataattctcagctaaaatgccagtatttctttcccttgtcttgaactctatgaatgaaaaaaaaaaatagtgttggtttatagtataatccttccagttatgttttaaagttctgcagtactcccaaa

SEQ ID NO: 80304 - DNA, 601 bp, Human
gcaagctgtgtctggggccctttgagctaaggctggagctggagtgacctggatgcagggagcagtgtcccaagtctgcacaaagcaacagggccctaggccctgcccacaaaaccactattttctcctagacctttgggcctgtgatgggaggggttttctagaagatttctaaaattcctttgaggccttttcccattgtgctggatattagcacttggctcccttttagttatgcacatatctctagcaagtggttgctccacagcctgcttgaatttggctccccaaaaagcctttycttttttgccatgtggccaggctgcaaattttccaaacttttacactctgcttcccttttaaatataagttccaaatttaggtcatttctttgctcttgcctctgaacataggcagttagaagcagccctggtatatcttgaacaatttgctgcttagaaatttcttctaccagatacctaaattatcactatgaagttcacacttccacagatccctagggcagaggcacaatgcagccaagttcatgcatgagtcacctttgctccagttcccaataagttcctcatttccatctgag

SEQ ID NO: 80305 - DNA, 601 bp, Human
agactggacagtaagcatagtgcccgcttctgcttctggggttgcctcagaaagtttacaatcatggagaaaggtgaagggagagcaagcactccacatggtgaaagcagaagtaagcaaaagagagagagaagtgtctggggggaaagagagatgccacacacttttatatgaccagaccttgcaagaactggtcgtggtcatgaagacagcaccaagccatgagagatctgtctgcatgatccaaaccacctggccccacggcaaccccaccttcagcattagggattacaactcaacrtgagatttgggcagggatagatatccaaactgtatcacagattaacaggagaaagtgtatatgcatttatcaagtgcattttcttttataggaaagaaaagtgaatactcaagaaaccagttagacttaaaagcttattaccctctctttataagggagaagagagtggggatgcagacaagttagggggtataaatgatttgggggaagatgatggggtccatagaagaagaggtgacagtctgtgacaaagtttgtctgggtgtggcatgaacttccagttaccccttctgggatatg

SEQ ID NO: 80306 - DNA, 601 bp, Human
cctgccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgmtctcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaa

SEQ ID NO: 80307 - DNA, 601 bp, Human
ctgccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgckctcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaaa

SEQ ID NO: 80308 - DNA, 601 bp, Human
tgccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgctmtcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaaac

SEQ ID NO: 80309 - DNA, 601 bp, Human
gccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgctckcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaaact

SEQ ID NO: 80310 - DNA, 601 bp, Human
attctgttttccggtgcctaaaagtggatgggtctgtcacatagtaggaactcattttttaaaaaaaaactgaatgaaaagaaaacaagaatgaaaataattagtagcaactactcccaaggggaatgtagaggctgttgggggaagtggtttccttatacaatgaaaggaggctgagctgtggtcttttacaggaacatcagatctcgtgttatctgacttctttgccaacccagatccagctcaaggtaaaaatctaagcaacttgggctaacatccaaccaagacagggatgggcagrctgattttcaagataagaataagagaaagtttcagaaccgtcttagtaaaacatgtacacacaatttaagacaaagaataagcatgataatcaccttgtggatttctttagcctgttaactttgctaatcttgtcagtcctgtctcctttaggctcgttcctaaagtaatacatagcaaaggagtaagcagtgataaaatttttaaactgagttgaatagatgggtgtgtgtttgtgtgtgtgtgtgtgtgtgtgtgttcagatatgggtgttgacaacaaggagcaggggatctcccat

SEQ ID NO: 80311 - DNA, 601 bp, Human
tgataaaatttttaaactgagttgaatagatgggtgtgtgtttgtgtgtgtgtgtgtgtgtgtgtgttcagatatgggtgttgacaacaaggagcaggggatctcccatgtagtgatggttgtaaaaagaaaggaaagttggctgggcacagtggctcacatctgtaatccaacactttgggaggccgaggctggaggattgcttgaggtcaggagttcaagaccagcctgggcaacacagcgggaccctatctctaaaaataaataaaaaattagccagccatagtggcacacatctacmgtcccagctacttacttgggaggctgaggtgggaagatggcttcagctcatgagatcaaggctgcagtgagctcggatcatgccactgcactccagcttaggtgacagagcaagatcctgtttcaaagaaaaaaaaaaaaaggagaggaaagaaataaaagtcaccttgtccctggggctttgaggaactagtgaaaggacagaaaagtggcccaggttgctttgtggtaggaaacagtggcactattcctgagcttagatagaaatatatactgggaaccacaggctctctgccagtgt

SEQ ID NO: 80312 - DNA, 601 bp, Human
tgaaagaataaagaatagctactctatagacggggcagagcattcccaaaagcaagaggaggaacatgcccaccttgggtgcaatgcttttatatatataagataacaaagcaaaaaaatcatgggggagatgtgctttactacaagagcttttgacaaataattgttaattcttgtgtaactacagtcttctgcaagaatttatattattatctttaaagtgaaactgattcttagtttaagaatgcttttgttcttaagatatcaggacatcaggacatttcctgggtctgttaggtcrtaggtctgttcagtaaacacgattaacttattctcttaactgtaaatatcctgttaactaagaatgcctaacctcctggggaataaaacccagcaggtctgagcttcattttacccagctcctactccaagatggagtccccctggtttgaatgcctttgacaatggggttcagattcaaacaataattattgaatgactcttgtgtgcctggcacattaaaaggtggcttcccattcattatctcattcaaacttcacagtactttggtgacataggtatcataaccttatttcatgaa

SEQ ID NO: 80313 - DNA, 601 bp, Human
cacgctgttctaatgagcgcctgggtacagacgggctgaggtctacaatggcgtcagcaccaaatgagtatgcggcaggggtttataaagtctcctgtaaacaggaagtgtctcagtctgatgtaactgctacgcagtacgcggacggcctctctttccgtcttcagcgggtacgtgtcttccgggcagccctcttcctgcttctgctatcttgctgacgcaggctgctgactcaagtggtcttgagccttgggactgggcctgagaagggaggagttattcaccctccaccccgcagctyccaggcccagtggaaagtctttcaatagccaccatcagtttctacggagcaacatgtaaaaaattacaaaagtaggaacattgcaaatgctttctcatggcggaattaatggcgacaagaaaattacgaaagcatcgaagcacttttaaggctgagttttaatcctaagaaacacaaatgctaaatataaaattccagtcaatcaacaagtgctagcctcgattatttaatggtaaacagttgggaaaaagctcaaattaacacgaaatactaaataagagactaataaatatttcatct

SEQ ID NO: 80314 - DNA, 601 bp, Human
acagcagcttcttctgtttgtaaaatattgttcaatgacaagtcagacagatagaaacctccaaagcatggtggctattgtggacaaaatttgtgaaaatattttacattggaccttccagtaagcattttcgcagccctaggtcacatcttgaaattatacaattggatccccccaaattgggttgaagtgctgacaaacgagaggatgtaacagatcaaaactgatctggatgatgggtgagtgaagtgcaggcagatagaggacagagataaacccatacatgccttacgggagtttstggctttaagtggagtccatccttgtaagtggtgcattaaacaaagagtttattgtaaagtgggcctgatccctggaggaaaagaaaattgattctttttcactggagggaagttaactctttctgtccttttgcagcagagaaggtgctgaacacatatttagtgatgaatttccctggttagttccaaggggtctttatgtcaggaatagtatttattcatactgcattttctatgtaatagagaggcaggattccctaaagtcccccgttataatcccttcatcccatctagcacag

SEQ ID NO: 80315 - DNA, 601 bp, Human
tatacaattggatccccccaaattgggttgaagtgctgacaaacgagaggatgtaacagatcaaaactgatctggatgatgggtgagtgaagtgcaggcagatagaggacagagataaacccatacatgccttacgggagtttgtggctttaagtggagtccatccttgtaagtggtgcattaaacaaagagtttattgtaaagtgggcctgatccctggaggaaaagaaaattgattctttttcactggagggaagttaactctttctgtccttttgcagcagagaaggtgctgaacacrtatttagtgatgaatttccctggttagttccaaggggtctttatgtcaggaatagtatttattcatactgcattttctatgtaatagagaggcaggattccctaaagtcccccgttataatcccttcatcccatctagcacaggtagactgtgaaaaacacatattctaatagttactaagctgttaaaattggctacaatacttttatttttgtttgttttgcacaggagtaactcaagatgattttgatgttgcagttttaaatttcactttgacttgagctgggaaatcctttggcc

SEQ ID NO: 80316 - DNA, 601 bp, Human; identical to SEQ ID NO: 38703

SEQ ID NO: 80317 - DNA, 601 bp, Human; identical to SEQ ID NO: 38704

SEQ ID NO: 80318 - DNA, 601 bp, Human; identical to SEQ ID NO: 38705

SEQ ID NO: 80319 - DNA, 601 bp, Human
gcctctgtgttgacaaacggccctgcaaaattatgcatagggaggagtagagacgtgaggggtggtgggctagatgctgccatgacttgccacaccacgcctcaggtcacgtaggatctgggtttgtgcctcagcagaattacagatggttacattgcatcatgggcctctggagctctggggaatagtgttgaatctattttaagaaaagctgggtgcttgcaggacagagcattggttctgcttaaactcctggggctccaaaacaaaagatcctcatcccccgtctttcccctttggytctgtgcatactgtttggaatctgtaaagtgattccttctgtttcaagtttcatctctgggaagccttctgtgtccacagcagctcttgctgatctcagcacacttagagagttaattcattcaataaatgcgcaacaagtgcctgctctgggctggcgctgtgctgagtcctaggacacagaggaaggaaacactaccttcaccttttaggaactcacaatttggtgaaaggaacacaagagctggacagatgactgaccccgagagttccaggggattgccgagggcagccatagggc

SEQ ID NO: 80320 - DNA, 601 bp, Human
tgggtgcttgcaggacagagcattggttctgcttaaactcctggggctccaaaacaaaagatcctcatcccccgtctttcccctttggctctgtgcatactgtttggaatctgtaaagtgattccttctgtttcaagtttcatctctgggaagccttctgtgtccacagcagctcttgctgatctcagcacacttagagagttaattcattcaataaatgcgcaacaagtgcctgctctgggctggcgctgtgctgagtcctaggacacagaggaaggaaacactaccttcaccttttagkaactcacaatttggtgaaaggaacacaagagctggacagatgactgaccccgagagttccaggggattgccgagggcagccatagggctgcaagactaagcactgcacagcatcctggagtattatttttacctaaaatttgggaaagaacttttttcttcttttgtgtaaaacaagcatgaatctattatagagtaggttccaatatgaattttgagctgaaacagatgacagaggccaaagaatagggcctgtcatatgatagatattcaatgaacacttgaacagttctcatctttc

SEQ ID NO: 80321 - DNA, 601 bp, Human
gacacagaggaaggaaacactaccttcaccttttaggaactcacaatttggtgaaaggaacacaagagctggacagatgactgaccccgagagttccaggggattgccgagggcagccatagggctgcaagactaagcactgcacagcatcctggagtattatttttacctaaaatttgggaaagaacttttttcttcttttgtgtaaaacaagcatgaatctattatagagtaggttccaatatgaattttgagctgaaacagatgacagaggccaaagaatagggcctgtcatatgatwgatattcaatgaacacttgaacagttctcatctttcatgttgtccctgtctccatccactgacttttttttttttcctttttttgaaatagtgtctcacattgttgcccaggctggagtgcagtggcatgatctcggctcactgcaacctctgactcccgggttcaagcgattctcctgcctcagcctccccagtagctggaactacaggcgcatgccaccatgcccgtctaatttttgtattttttttagtagagacggagtttcaccatgttggccatgcaggtcttgaactcttaac

SEQ ID NO: 80322 - DNA, 601 bp, Human
attctcctgcctcagcctccccagtagctggaactacaggcgcatgccaccatgcccgtctaatttttgtattttttttagtagagacggagtttcaccatgttggccatgcaggtcttgaactcttaaccttgagtgatctgcccacttcagcctcccaaaatgctataattacaggtgtgagtcaccacacctggccaacatccactgactcttgcagatactgcgtgccagcccccatctgtccaccgccatctagcccccagctctgcccagtctgccttgtgctcccttcagccaracacttaactgcttgctctccctctgctacccaggaaaccactgttgctgcgattgccccggatatgccagaggaacctgatgtccctgctgatggccgttcggccatcgctgccggaaagtgggctcctctctgtgctgcagattgcccagcaggacctagcccctgaccccgatgcctggctccgtgccctgggggaattgctgcgaagggatttgggggtggggacctccatggagggagcttctccactgtctgaaagatgccagagacagctccaaagtctatgtagggggctgg

SEQ ID NO: 80323 - DNA, 601 bp, Human
ttgctgtgtgcccagctgcagctccctcagctctcagacctcggtctcctgcggctctgcacctggctgctggccctttcacctgatctcagcctcagcaatgctactgtgctgaccagaagcctctttcttggacgggtaggtgtattgggaggtactcagagtgccaaggacaatggggaagagcaactgggccctcagaagggtggtacttgagagaggggattcccagccttgtagacatctgggctgtttgggcagcctggggcaaggaaaggatgcctgcttaactggcagggcrtggacccccaggccatctacccacatggcatctaacttttttttttttttttgagagagagtgtctcactctgttgcctaggctggagtgcagcagtggcgtgatctcctgcctcagcctcctgagtagctgggatcacaggtgccttccaccatgcctggctaatttttgtatttttatttatttatttatttagagacggagtcttgctctgtcactcaagctggagtgcagtggtgcaatcttggctcactgcgacctctgcctttggggttcaagcgattctcctgcctcaacctc

SEQ ID NO: 80324 - DNA, 601 bp, Human
agtgcatggagggtcaagcaggacagctgccctacagcagctgcctgagacagtgggagagccctgggccatgcaaagctggtagcagagagctgagcacatggtcacttcagctccacctcttaccagctgggggggccttgggggtgggatttttgatgtgtgtgtgtgaatttaattttatttttgaataggtaatagattcatatgttcacaaatttttttttttttttagatagagtctggctttgttgcccaggccgaagtgcagtggcacaatcttggctcactgcaacctctrcctactgggttcaagcaattcttgtgcctcagccacccaaataactgggattacaggcgtgcgccaccacgctggctaatttttgtatttttagtagagatagggttttgccatgacctgaggccagaactcctgtggcctcagccacccaagtaactgggattacaggcgtgcgccaccacaccggctaatttttgtatttttagtagagacagggtttcaccatgacttgaggccagaacttctgggctcaagtgatctgccctccttgacctcccaaagggctgggattaaaagcgt

SEQ ID NO: 80325 - DNA, 601 bp, Human
ctaatcttttgtatttttagtagagatggggtttcaccatgttagccaggatggtctctatctcctgacctcgtgatccaccggcctcggccttccaaagtgctgggattacaggcgtgagccaccgtgcccagccctgacctaacttctttatgcctgtggtttcctcatctacaaaaggggagatataatattaatagcacctaccatataagactggagtgaggtttaaatgagataattggtgtaaagtagtcagaatggtacctgatgcacagtgtttattaaataataataataattattattttttttgagacggagtctcactctatcacccaggctggagtgcagtggcataatctcggctcactgcaacctctacctcctgggttcaagtgattctccagcctcagccccctgagtagctgggattacaggcacgcaccaccacgcccggctaatttttgtatttttaatagagacggatttcaccatgttggccaggctggtctggaactcctgacctcaggcgatccacccgccttggcctctcaaagtgctgggattacaggcatgagccaccgtgcctagcataaat

SEQ ID NO: 80326 - DNA, 601 bp, Human
ttttgtatttttagtagagatggggtttcaccatgttagccaggatggtctctatctcctgacctcgtgatccaccggcctcggccttccaaagtgctgggattacaggcgtgagccaccgtgcccagccctgacctaacttctttatgcctgtggtttcctcatctacaaaaggggagatataatattaatagcacctaccatataagactggagtgaggtttaaatgagataattggtgtaaagtagtcagaatggtacctgatgcacagtgtttattaaataataataataattatttttttttttgagacggagtctcactctatcacccaggctggagtgcagtggcataatctcggctcactgcaacctctacctcctgggttcaagtgattctccagcctcagccccctgagtagctgggattacaggcacgcaccaccacgcccggctaatttttgtatttttaatagagacggatttcaccatgttggccaggctggtctggaactcctgacctcaggcgatccacccgccttggcctctcaaagtgctgggattacaggcatgagccaccgtgcctagcataaattattat

SEQ ID NO: 80327 - DNA, 601 bp, Human
gtggttgggaattgggacgggcttcctgacttttttttttttttttgagtcggagtctcgcactgttgcccaggctggaatgcaatggcatgatctcggctcactgcaacctctgcctcctaggttcaagcgattctcctgcctcagcctcccgagtagctgggattacctgccaccacgcctggctaattttttgtatattttgtatttttagtagagacggggtttcactatgttggccaggctggtcttgaactcctgaccttgtgatcagcccgcctcggcctccaaaagtgctggrattacaggcgtgagctgtcgtgcccagacttcctgactcttaaaaggtgaatggtagtcaagagccagagatgagaggaagggcatttcaggaaaaagatacagtgtgagcagtgagtgtctgaggggatctgcaagtagttcattgtggatggagcctaaaaatgtgagaatggatggtggtgggggataagattagagagctaaagtactaagagctattatttctacagtacctgccatgtctcagtcatggttcttttattaaatttaatttttcaaaaatagagacagggtcttc

SEQ ID NO: 80328 - DNA, 601 bp, Human
ggggtttcactatgttggccaggctggtcttgaactcctgaccttgtgatcagcccgcctcggcctccaaaagtgctgggattacaggcgtgagctgtcgtgcccagacttcctgactcttaaaaggtgaatggtagtcaagagccagagatgagaggaagggcatttcaggaaaaagatacagtgtgagcagtgagtgtctgaggggatctgcaagtagttcattgtggatggagcctaaaaatgtgagaatggatggtggtgggggataagattagagagctaaagtactaagagctawtatttctacagtacctgccatgtctcagtcatggttcttttattaaatttaatttttcaaaaatagagacagggtcttcttttttttttttttttttttttgagacagagtctcactctgttgcccaggctagagtgcagtggcgcatctcggctcactgcaagctccgcctcccgggttcacgccattctcctgcctcagcctcctgagtagctgggactacaggcgcgcgccaccatgcccggctaattttttgtatttttagtagagatggggtttcaccctgttagccaggatggt

SEQ ID NO: 80329 - DNA, 601 bp, Human
aaaaatgtgagaatggatggtggtgggggataagattagagagctaaagtactaagagctattatttctacagtacctgccatgtctcagtcatggttcttttattaaatttaatttttcaaaaatagagacagggtcttcttttttttttttttttttttttgagacagagtctcactctgttgcccaggctagagtgcagtggcgcatctcggctcactgcaagctccgcctcccgggttcacgccattctcctgcctcagcctcctgagtagctgggactacaggcgcgcgccaccaygcccggctaattttttgtatttttagtagagatggggtttcaccctgttagccaggatggtctcgatctcctgaccttgtgatctgtccgccttggcctcccaaagtgctgggattacaggtgtgagccaccgtgcccggccgagacagggtcttcttatgttgcccaggctggcctcaaactcctaggctcaagcaatcctcccatcttggcctcccaaagtgctgggattacaggcttgagccaccacacccagcctcaggcgtggctctaagccctttacatatatgaacttgctag

SEQ ID NO: 80330 - DNA, 601 bp, Human
tgtgatctgtccgccttggcctcccaaagtgctgggattacaggtgtgagccaccgtgcccggccgagacagggtcttcttatgttgcccaggctggcctcaaactcctaggctcaagcaatcctcccatcttggcctcccaaagtgctgggattacaggcttgagccaccacacccagcctcaggcgtggctctaagccctttacatatatgaacttgctagtttattccatgtgtcagccctgtgagagatattcttttttttttttttttttttttgagatggagtctcgctctgtcrcccaggctggagtgcagtgctgcgatctcggctcactgcaagctccgcctcctgggttcacgccattctcctgcctcagcctcccgagtagctgggactacaggcgcctgccagcacgcatggctaattttttttgtatttttagtagagacggggtttcactgtgttagccaggatggtctcgatctcctgaccttgtgatccaccctcctcagcctcccaaagtgctgggattacaggtgtgagccaccgcgcctggcctgagagatattcttattattccgtttcatagatcagaaa

SEQ ID NO: 80331 - DNA, 601 bp, Human
gcttggaagcaattaagaaacccaagatagagcaggggattatgctcgctcgccacggatacgacgcgcaagctggatgtccttaggcataatagtgacacgcttggcgtgaatagcacagaggttggtgtcttcaaagagacccaccagataggcctcgcacgcctcttgcagcgccatcaccgccgagctctggaaacgaaggtcggttttgaaatcctgcgcgatttctcgcaccaggcgctgaaatggcagtttgcggatgagcagctcagtcgacttctgataacggcggatctcrcgcaaggccacggtgcctggcctgtagcggtggggcttcttcacaccgccagtcgctggagcgcttttgcgcgctgccttggtggccagctgcttccgcggtgccttgccgccggtagacttgcgagctgtctgcttcgtccgggccatagttgagaaagctatgctctgaaagcaagcagctgaatgagcagtggcttctaccagaatttataacgatgatctgatcctgattggtcagaactgttgtaggaaaaacctggttggttgttaatactatcttcatttggttcctgccact

SEQ ID NO: 80332 - DNA, 601 bp, Human; identical to SEQ ID NO: 38075

SEQ ID NO: 80333 - DNA, 601 bp, Human; identical to SEQ ID NO: 38076

SEQ ID NO: 80334 - DNA, 601 bp, Human; identical to SEQ ID NO: 38077

SEQ ID NO: 80335 - DNA, 601 bp, Human; identical to SEQ ID NO: 38078

SEQ ID NO: 80336 - DNA, 601 bp, Human; identical to SEQ ID NO: 38079

SEQ ID NO: 80337 - DNA, 601 bp, Human; identical to SEQ ID NO: 38080

SEQ ID NO: 80338 - DNA, 601 bp, Human; identical to SEQ ID NO: 38081

SEQ ID NO: 80339 - DNA, 601 bp, Human; identical to SEQ ID NO: 38082

SEQ ID NO: 80340 - DNA, 601 bp, Human; identical to SEQ ID NO: 38083

SEQ ID NO: 80341 - DNA, 601 bp, Human; identical to SEQ ID NO: 38084

SEQ ID NO: 80342 - DNA, 601 bp, Human; identical to SEQ ID NO: 38085

SEQ ID NO: 80343 - DNA, 601 bp, Human; identical to SEQ ID NO: 38086

SEQ ID NO: 80344 - DNA, 601 bp, Human; identical to SEQ ID NO: 38087

SEQ ID NO: 80345 - DNA, 601 bp, Human; identical to SEQ ID NO: 38088

SEQ ID NO: 80346 - DNA, 601 bp, Human; identical to SEQ ID NO: 38089

SEQ ID NO: 80347 - DNA, 601 bp, Human; identical to SEQ ID NO: 38075

SEQ ID NO: 80348 - DNA, 601 bp, Human; identical to SEQ ID NO: 38076

SEQ ID NO: 80349 - DNA, 601 bp, Human; identical to SEQ ID NO: 38077

SEQ ID NO: 80350 - DNA, 601 bp, Human; identical to SEQ ID NO: 38078

SEQ ID NO: 80351 - DNA, 601 bp, Human; identical to SEQ ID NO: 38079

SEQ ID NO: 80352 - DNA, 601 bp, Human; identical to SEQ ID NO: 38080

SEQ ID NO: 80353 - DNA, 601 bp, Human; identical to SEQ ID NO: 38081

SEQ ID NO: 80354 - DNA, 601 bp, Human; identical to SEQ ID NO: 38082

SEQ ID NO: 80355 - DNA, 601 bp, Human; identical to SEQ ID NO: 38083

SEQ ID NO: 80356 - DNA, 601 bp, Human; identical to SEQ ID NO: 38084

SEQ ID NO: 80357 - DNA, 601 bp, Human; identical to SEQ ID NO: 38085

SEQ ID NO: 80358 - DNA, 601 bp, Human; identical to SEQ ID NO: 38086

SEQ ID NO: 80359 - DNA, 601 bp, Human; identical to SEQ ID NO: 38087

SEQ ID NO: 80360 - DNA, 601 bp, Human; identical to SEQ ID NO: 38088

SEQ ID NO: 80361 - DNA, 601 bp, Human; identical to SEQ ID NO: 38089

SEQ ID NO: 80362 - DNA, 601 bp, Human; identical to SEQ ID NO: 22600

SEQ ID NO: 80363 - DNA, 601 bp, Human; identical to SEQ ID NO: 22601

SEQ ID NO: 80364 - DNA, 601 bp, Human; identical to SEQ ID NO: 22602

SEQ ID NO: 80365 - DNA, 601 bp, Human; identical to SEQ ID NO: 22603

SEQ ID NO: 80366 - DNA, 601 bp, Human; identical to SEQ ID NO: 22604

SEQ ID NO: 80367 - DNA, 601 bp, Human; identical to SEQ ID NO: 27826

SEQ ID NO: 80368 - DNA, 601 bp, Human
actaagaccatttatattttatttctatgctttgtataatttttcttaataaagaggctaattaacaattgtctctgacatcactaattagacttctattttaattataatttttattccaaatacatgcttgcattgatagttattaaggtttacaattttaagagaaacttggaaaaaatgtacacacatatcagagtgtaaatacatatatttgtcaagtacttgtagaaataacattacctgataactgttgattctggagggtttgaatgtatccagtaagtagtagttattgcarcctgcagagtggcatctggtattttccttttaatgtcttagtttagttgccaaacctctttgtgatagaggatttcctgagttttcgtcagtaaagtcttgagtgctctagagagaaatagaaggagagaaaaagagggcttcacaatcagagattgtcttcaaacactggactcaaagctatgcagacactgaatttctatctgtcctcttttaggacttctgcttttatttcccaggaaatgtgggatgaggatggctgagaagtcatcttttaaaaagcaatttaaaatcttgcggc

SEQ ID NO: 80369 - DNA, 601 bp, Human
atacaagatcactgattttaacctttcctgctactgctgtgtggtcttagttcatccctgaccgttttggaaattcgacttagtgaatatacattttgtgtagtctgtaagatatttaacaagtattcttgacattgagaatttcagctccctttatctgtatttaaatctcattttatacttgaggcaaagtaactaagaccatttatattttatttctatgctttgtataatttttcttaataaagaggctaattaacaattgtctctgacatcactaattagacttctattttaattrtaatttttattccaaatacatgcttgcattgatagttattaaggtttacaattttaagagaaacttggaaaaaatgtacacacatatcagagtgtaaatacatatatttgtcaagtacttgtagaaataacattacctgataactgttgattctggagggtttgaatgtatccagtaagtagtagttattgcaacctgcagagtggcatctggtattttccttttaatgtcttagtttagttgccaaacctctttgtgatagaggatttcctgagttttcgtcagtaaagtcttgagtgc

SEQ ID NO: 80370 - DNA, 601 bp, Human
gaaatgacatttgtaatctttttatttcaccagagataagtgaaattgattctatataaaatattcttaataatcagagatatattgaaagtacaaataacaaattttaaaaaataactttcgtgtaaaagatatttagataaatgaatgtagcacttaaattccccaaaatgtccatggaattcctttctgtccttaattatggaaggaaaacgattaagaatcatgttgtcacagtatggcttcaattttcagcatctcctcacctatttagcgctttaaaataatgctaaacaaaacytaatgttttccaatacaagatcactgattttaacctttcctgctactgctgtgtggtcttagttcatccctgaccgttttggaaattcgacttagtgaatatacattttgtgtagtctgtaagatatttaacaagtattcttgacattgagaatttcagctccctttatctgtatttaaatctcattttatacttgaggcaaagtaactaagaccatttatattttatttctatgctttgtataatttttcttaataaagaggctaattaacaattgtctctgacatcactaattagact

SEQ ID NO: 80371 - DNA, 601 bp, Human
catgtgtatcttatttccaactttcctcagtgttttgaagttgctgcatacattttcttgaatatcattcagtataaattttaaaacagtaaaaaaaaaaataagagtcagaaatggcctgtgtatatatggtcatgagttggcattcctcaaaacagggcatactttccagatttatggagtgtgtaatggtagctaaaataaaatataggttattaccacaataggcagctataatgaaaactaacaagtgacttgaatatgctatatggcatctacatcttgggaatttgaaatgacrtttgtaatctttttatttcaccagagataagtgaaattgattctatataaaatattcttaataatcagagatatattgaaagtacaaataacaaattttaaaaaataactttcgtgtaaaagatatttagataaatgaatgtagcacttaaattccccaaaatgtccatggaattcctttctgtccttaattatggaaggaaaacgattaagaatcatgttgtcacagtatggcttcaattttcagcatctcctcacctatttagcgctttaaaataatgctaaacaaaacctaatgttt

SEQ ID NO: 80372 - DNA, 601 bp, Human
gcacattttgtcttagagctcactcatatttatatgcaaaagctggaagagaaataatggggctgtgctttactcttctctagcttcccctccatgccttttagctttttggtttctattcacagtcacttttccccccaacgtccttatttctgagcttcttttactgtagtaccgtcaaaacagttgagagagaaatgatggataattgcctgttagaatcctaaagtaataaaaagggggaagaaattgatgaaaaattactcttgggaaacttattaaataaaatactgaatcagtaaaaaaaaaaaaaagctgaccttttttctttatatttggaagatattcctgcctctatattgctcactcattcaaagattggcctcacggagattcattattctgcttcaaatattttaacccatgtgtatcttatttccaactttcctcagtgttttgaagttgctgcatacattttcttgaatatcattcagtataaattttaaaacagtaaaaaaaaaaataagagtcagaaatggcctgtgtatatatggtcatgagttggcattcctcaaaacagggcatactttccagatttatg

SEQ ID NO: 80373 - DNA, 601 bp, Human
tagatgcttagtatttttttatttgttgaatgtttgcctcttaaagcacattttgtcttagagctcactcatatttatatgcaaaagctggaagagaaataatggggctgtgctttactcttctctagcttcccctccatgccttttagctttttggtttctattcacagtcacttttccccccaacgtccttatttctgagcttcttttactgtagtaccgtcaaaacagttgagagagaaatgatggataattgcctgttagaatcctaaagtaataaaaagggggaagaaattgatgraaaattactcttgggaaacttattaaataaaatactgaatcagtaaaaaaaaaaaaaagctgaccttttttctttatatttggaagatattcctgcctctatattgctcactcattcaaagattggcctcacggagattcattattctgcttcaaatattttaacccatgtgtatcttatttccaactttcctcagtgttttgaagttgctgcatacattttcttgaatatcattcagtataaattttaaaacagtaaaaaaaaaaataagagtcagaaatggcctgtgtatatatggtc

SEQ ID NO: 80374 - DNA, 601 bp, Human
ctttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctcctyacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtg

SEQ ID NO: 80375 - DNA, 601 bp, Human
ctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcgcatcgtgttttgtcctcgatgaacattccactgttattatgtcattctcagacatctgaaagcttttctgggaagtttcactaatatgcacataatatagcacaaggtgtttaagtgagtaccgtatttgggayttctagttcctgtttcttgaagagtttagagactaaatgtactctgtgtgccatatgattctagcagatgtgtatgtagcattgtgtatctgtaaatactgaatgaggattattgggtgtgatcagaccctttctatagagggaaggatggtaacatgagacaaattaatgtcctcagtttgaaaatctagtcatagaaacttggcgaatcctcaaaggattatgctccctcttactctggcagttattaaggaattgatttttccattaattagtagcttgaagtcaagagtctctgaa

SEQ ID NO: 80376 - DNA, 601 bp, Human
atgtgaacaatctctcttcagactccagggaaaatgcccaagatggtatattgcgtatggcgcaggtttcctgttttagctctttggtcagctgagaaaattggtgaggcctgatctgctgaaggatgacctgaattaaccctcctggtaactgaccttttgacctcactattttctggttgctctgtatgctctttggtggaccggcctttcagtcaatgggctgtccccatgggtgatactagtgttaaggtggtcaacatttgtttgcaactcctgcatataatgctatttctgtttyctcctgtttcaataccttcagaatgggcaaaccctcactccattaggtaagattcttaaaagccctattgaatggaaaggatcttggtttttttttttttttgagtcagagtctcgttcagtcgcccaggctagagtgcaatggcgcgatctcggctcactgcaagctctgcctcccgggttcataccattttcctgcctcagcctcccaagtagctgggactacaggcacccgccaccacgcccggctaattttttgtatttttagtagagacggggtttcactgtgttagccaggatg

SEQ ID NO: 80377 - DNA, 601 bp, Human
ggctcaactggggtgggagaatccacacccaagacggtgcatacatatggtctggctgttgagtgctctctatgtgggcctctctataggcagcttggcttccttacagcatggctgctgggttccaagagcaagtgtcccaagagaaaggaaatggaaatttcttattcttaaggtctgaattcagacactggtatgcatctctattaatgtgtaataagtggctcctcaaacttcatagcttgaaacaacaaacctttatctctcacagtctctgagagacaggagtccagagtgactkagctgggtggctctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacacctataatcccagcactttgggaggccgaggtggg

SEQ ID NO: 80378 - DNA, 601 bp, Human
gtgggagaatccacacccaagacggtgcatacatatggtctggctgttgagtgctctctatgtgggcctctctataggcagcttggcttccttacagcatggctgctgggttccaagagcaagtgtcccaagagaaaggaaatggaaatttcttattcttaaggtctgaattcagacactggtatgcatctctattaatgtgtaataagtggctcctcaaacttcatagcttgaaacaacaaacctttatctctcacagtctctgagagacaggagtccagagtgacttagctgggtggcyctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacacctataatcccagcactttgggaggccgaggtgggtggatcacgagg

SEQ ID NO: 80379 - DNA, 601 bp, Human
tcacagtctctgagagacaggagtccagagtgacttagctgggtggctctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacrcctataatcccagcactttgggaggccgaggtgggtggatcacgaggtcaggagatcaagaccatcctggctaacatggtgaaaccccgtctctactaaaaatacaaaaaattagctaggcgtcatggcgggcgcctgtagtcccatctactcgggaggcggaggcaggagaatggcatgaaccgggaggcggagcttgcggtgagccgatatcgcgccactacactccagcctgggtgacagagcaagactccgtctcaaaaaaaaaaaaaaaaaaaaaaaaaagccacagtgtcttgt

SEQ ID NO: 80380 - DNA, 601 bp, Human
gacctcttgcaacatagcagctgatttcctcagagccagtgatctgagggagagagaccaaataagacagaagccacagatgccaggcgcggtggctcacacctataatcccagcactttgggaggccgaggtgggtggatcacgaggtcaggagatcaagaccatcctggctaacatggtgaaaccccgtctctactaaaaatacaaaaaattagctaggcgtcatggcgggcgcctgtagtcccatctactcgggaggcggaggcaggagaatggcatgaaccgggaggcggagcttgsggtgagccgatatcgcgccactacactccagcctgggtgacagagcaagactccgtctcaaaaaaaaaaaaaaaaaaaaaaaaaagccacagtgtcttgttaggacttagccttcaaagtcacacagcatcacttctgcttagtgactagaagcaagtcactaagttcagttcagcccacaggcaaggggaaggaaacaggttttaccccaaaggaggagtattaaagaatttggtgggcatatttttataaccactgcagtgttacttccattgtgttttattggtccagcattcctgg

SEQ ID NO: 80381 - DNA, 601 bp, Human
ccaggatacacagagctctgaattgtaggctaaggataagagcattttagggagccattaccatgttttagcggagtagtgacatgattaaaaccagactttaggaagcgtaatccggccatgttgtacacagagggatggatgtggcaacaccttgggagtcatggaattaactaggatgttagaaatgaaaaaaggaagaaaagtaggctagtataggaaatctactacagataggtaattattgatttttggaagaaccatgatgatattaatatatccagttgagtgtggtgtaatrcacattaagaaaagtaatttagagagcccattgtttctctcccttttcactgtacacaccttaagtgtgttttagtcacctctttttttccattctctatttctgtttcaattttcctgttcagcagaggatagtttggtttaaagccgatagcaaaagtggattctgttgttgctgtccttcctagacatatcagtccgttctcacactgctgtaaagaaatacctgaggctgggtaatttataaagaaaggaggtttaattggcttatgattctgcaaattgtacaggaagcatggca

SEQ ID NO: 80382 - DNA, 601 bp, Human
ttttcaggcaaatgtgtgaatggcctgtttaaaggaagcaatggggaagcagggagcccagtctgctagtcaggggagatgtctctaagtttttatctctcgccactggcttgagccattgggtgtggtttccttctaatgcctgggcagctgtgtcattcccgttacagtcaccacatgattctaattgccttagaatttataggaaccagttggcagcccaacaagtgggctcctctggccagtgagggagcctggtgagggaatcttcccaggacaggcagagacatctgcctggttyttagattggccatctttggtctcacctcagtttggatatattttttttttatctcacctgcccccttgttatctgcttccaagaagcaaacagctcaaataattatttattttaaaataacataagaggatgtctctgatactccaaaagccttttttttttgaaaaaaaaaaaaaaaggatggttctatccaatttggcatttcatttatagagaataaaaactatctatacccaaaatgtattcattgcacacaattgtatttgaatggcagctggaaatcttctctcctaactgatg

SEQ ID NO: 80383 - DNA, 601 bp, Human
aaaattagggaagccatcagttattaatccagtcctgaacattttgagtcaattgttacagaagttattatttagcttcctggatagttactagagagcaatttggcttccagcaggtctgatttagagcaggccagcttccggggttgctttttgtgggtaagggtattgttttctgggaaagttgctgcaccttgtggatcagagttccatcttttgctatggcctggctgttgtccgattgtatatttagtcagtcaccaggcaccacattttctcaagctgttggaaagttctgtgkgtccagtgttatcttccccttgtattctatgaaatatatggctgtctgaaatgtttgatgtgcaaagccagccatggggctctgctcacagcaaatgcttttggctatctcaggaagtcatggtgactggaagaaatgcacaaccctgacagaaaatggcaaattctagctgaagggacctccagggagaagggggttggggaggggagcagttggctggggcttcttggccgcctccattgccctttggttcagccagcccaggctcacagcagatatccttgacctcgccaagggaag

SEQ ID NO: 80384 - DNA, 601 bp, Human
tgcttaactgtgcacttgagcttgcagttccttgaaagatctggtgtcacgcaagacaaattatacagcagtctactatttctggagtttgatcattctcagcactggctttatttctttttttccactaaagaagtatagttcaaatgtggataggtgaaagtagataatcttaggaggatcgttacaaactgaaatgtccatgagttcaggaaagtgccatgtgtgtgaggggtaccccaggtgagaggcctgaggattgggcaggtgaaagggaccatgtgggcacaggattcatccscctcaccatgtgctttctcactttagtgatgatttctacccaggtgttgactaagtcacttattgacatgagatcagaagaaacaagttcaagttcagcaatctcgcatgggatcttagaactctgaaactctgtgaccttcacaaggttacctctgggtctagattttttaactggaaatcaaggacaatcattaagagactccccttcctggattgttgggaagattaaatgatacaatccaagtaatgagagcattgtagtctctaaaattggattctcaaataatgacctcaggtg

SEQ ID NO: 80385 - DNA, 601 bp, Human
cttcacaaggttacctctgggtctagattttttaactggaaatcaaggacaatcattaagagactccccttcctggattgttgggaagattaaatgatacaatccaagtaatgagagcattgtagtctctaaaattggattctcaaataatgacctcaggtgaaggaagaactgttcaaaatgccccaggtgctatgaagtacagagggcaggtattttttttaagggatggggtcttgctctgttgctcaggctacagtgcagtggtatgatcatgactcactgccacctcaagctcctsggctcaagtgatcttctcacctcagcctcccaagtagctaggactaaaggtgcataccaccatgcctggctaattttttaatttttttgtagagatgggggtcttgctatgttgcccaggctggtctccaactcctcaagcaaccttcccatcttggcttgccaaagtgctgggcttacaggtatgagccaccacacctggctgatatttgaattcagagatgctgaggataagtaatgttggaacagagtgggtaaagtcagcttcagcataaattgtgtttatttaatttaaacacaa

SEQ ID NO: 80386 - DNA, 601 bp, Human
gtctccaactcctcaagcaaccttcccatcttggcttgccaaagtgctgggcttacaggtatgagccaccacacctggctgatatttgaattcagagatgctgaggataagtaatgttggaacagagtgggtaaagtcagcttcagcataaattgtgtttatttaatttaaacacaatttaaattttgtgttttggctatctcaggaagtcatggtgactggaagaaatgcacaaccctgacagaaaatggcaaattctagctgaattttaaattgtgttatttgcggaataaaatatgtkgacaagtgctttaaaaaacctatgagaatacccaggtttcattcccttgttgaagagcaggcgggcacaggcatattgggatgccataggtggcatattcttctccacacacatcctccttggcatttagaaagggcctgtgaaagttatgaagattcaggtcacagatctctgatgggactttcttcaggtatcagcattgactttccaaattttcatcactgagctcctgaccaatttcagcagtcagagaggtctgcatcaagcaaggtcttggtctaagcctcatgggattagatc

SEQ ID NO: 80387 - DNA, 601 bp, Human
ttaaattttgtgttttggctatctcaggaagtcatggtgactggaagaaatgcacaaccctgacagaaaatggcaaattctagctgaattttaaattgtgttatttgcggaataaaatatgtggacaagtgctttaaaaaacctatgagaatacccaggtttcattcccttgttgaagagcaggcgggcacaggcatattgggatgccataggtggcatattcttctccacacacatcctccttggcatttagaaagggcctgtgaaagttatgaagattcaggtcacagatctctgatgrgactttcttcaggtatcagcattgactttccaaattttcatcactgagctcctgaccaatttcagcagtcagagaggtctgcatcaagcaaggtcttggtctaagcctcatgggattagatctgaggtcaaaatgcctataaagtattaatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggccta

SEQ ID NO: 80388 - DNA, 601 bp, Human
gactttccaaattttcatcactgagctcctgaccaatttcagcagtcagagaggtctgcatcaagcaaggtcttggtctaagcctcatgggattagatctgaggtcaaaatgcctataaagtattaatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggcctaggctttaattaatgatctctcctrtgttttaccaagggcactggtctctcgagcttgcagtgggttgcaagggattagagggtgtatttgcagcaaaacttctgtaccggcactcgctctgtatatatagtctcttccaatttgcttttagagatcttttctttctgactgtttgcaggaggacatggcacgctgtggcatattctgcctgatgtctctggaggcatagttggtgcccatcccactttttattaactctcttggttgaaaacacagcccagaagacatgttgggacttcataagcacagcctaaggaggaacat

SEQ ID NO: 80389 - DNA, 601 bp, Human
aagtattaatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggcctaggctttaattaatgatctctcctgtgttttaccaagggcactggtctctcgagcttgcagtgggttgcaagggattagagggtgtatttgcagcaaaacttctgtaccggcactcgctctgtatatatagtctcttccaatytgcttttagagatcttttctttctgactgtttgcaggaggacatggcacgctgtggcatattctgcctgatgtctctggaggcatagttggtgcccatcccactttttattaactctcttggttgaaaacacagcccagaagacatgttgggacttcataagcacagcctaaggaggaacattggaaggtacaacattgtacatgtggccaccctgccccaacgcagtcacacctctgtgctggtcctcctgcgagctccccagagcatggggtcccttgaggttctttgtggcatgcgg

SEQ ID NO: 80390 - DNA, 601 bp, Human
cctcggcctcccaaaatgctgggattacaggtgtgagccaccatgcccagctcactcttagacgttttagaataagcacataaatttctacaaaagaacctcataacattttgattggaattatattaaatcaatgaatcaatgtggggaaaattgaaatcttaccaatattgaacttccagtgtatgtatacagtgtatcttttaaattatttgtctttaatttgtctcagcagtttttgaaaaatagttttcactgtagagctcttgcacatatttaaagaaagtatccctcagtattwtgagatttaaaatattttgtaaattgtattttttaaaaaatcatcttctagttttttgttatttagacataagattgatgtttgtacattgaccttgtatcctgcaatcttgctacatttaatttatcatatatttttctcagtgctttacagaatttcttgtttattcttgtaactacctatgagtcaggtgttattgcaattatattttataagaaatttgccccagatgtgctaattttcttgctccaggtcacacaatttgagtaacaggggaggaatttaatttaggtcaactct

SEQ ID NO: 80391 - DNA, 601 bp, Human
ttgccccagatgtgctaattttcttgctccaggtcacacaatttgagtaacaggggaggaatttaatttaggtcaactctgattatatggcccagtccccttccacactgctataatatgtcatctctttgacatttgtatattattggaatggagtgacacattgtggtttctctggattccactgggacatttttgggtcatcatactttacgggagatggcttcaccaatggaactcctaaaatggacataacaagaataaggtgataaaaaagacggtgatttttccagtttaaggrgagcaatatttttccaggttctttccccagaggactgctaaggaaattgtacataatctcaaagtgcagtttctttgcccatgctgtgaatgtacattagctgctgctagatcttccatgtgtgtggatgctgtaaagcttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctg

SEQ ID NO: 80392 - DNA, 601 bp, Human
tccccttccacactgctataatatgtcatctctttgacatttgtatattattggaatggagtgacacattgtggtttctctggattccactgggacatttttgggtcatcatactttacgggagatggcttcaccaatggaactcctaaaatggacataacaagaataaggtgataaaaaagacggtgatttttccagtttaaggagagcaatatttttccaggttctttccccagaggactgctaaggaaattgtacataatctcaaagtgcagtttctttgcccatgctgtgaatgtasattagctgctgctagatcttccatgtgtgtggatgctgtaaagcttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaaga

SEQ ID NO: 80393 - DNA, 601 bp, Human
atcatactttacgggagatggcttcaccaatggaactcctaaaatggacataacaagaataaggtgataaaaaagacggtgatttttccagtttaaggagagcaatatttttccaggttctttccccagaggactgctaaggaaattgtacataatctcaaagtgcagtttctttgcccatgctgtgaatgtacattagctgctgctagatcttccatgtgtgtggatgctgtaaagcttgttttcccttcttctctcccacaacgtgctgtaggaaaccatttctggacggctaaagacytcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggac

SEQ ID NO: 80394 - DNA, 601 bp, Human
atcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaacygaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggat

SEQ ID NO: 80395 - DNA, 601 bp, Human
gttgtgttttgtggccaggcagaatgttctgtgccttatgtgaacgtcactgtgaagagcgtcatggagcacatggcccttttccttggggacatttttggcaggtgccttggcaaactgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccrtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatt

SEQ ID NO: 80396 - DNA, 601 bp, Human
ttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagaygctggttcagtgcaaattgagatggtaaaaacttatttcttaaaaaatggttcctaaataaatgtcatttactaaaacaaatgaaagaaatatatatatgaataaatggctatattttacaaagtatgcttatttaagaagaaataagaaaaaacggggctgataggaaccagatttgaaatagggcttttgtaaatactccgtaaattgaagtaaatgaagagtagtatttataagctagattgagaaatataaaatcagctagctgaagttaagtgcatcaatttgggatgaataaat

SEQ ID NO: 80397 - DNA, 601 bp, Human
tagggcttttgtaaatactccgtaaattgaagtaaatgaagagtagtatttataagctagattgagaaatataaaatcagctagctgaagttaagtgcatcaatttgggatgaataaattttcttttaaaatgtctatcaatttgtgtagagagaggtttcttcatagagatattagaatcaaagagtatgttcagtagttattctgtcttctttgtaatgaatacccttaagttggcttaacagctcagtacttatctttttttcttttcattcttaaaggtcaagccttgtttttgccrtatatgtaactagagacagtacgtttgaggctaaataactgtagtactagggaatgacaacacgctcacccaagacaccgcagcctggtttactctgtcatgataggaatgaggattgtacatttgaaataggtttctgctattgattttttaaatgtataaacgatggaaactacggaatttctcatgttttcaccacatagttttttgtcataaaatgaagaatatattatatccaagaatgaagaggaagtgaacaaatttgagcaaatttagtccagcaatattttcatttgaata

SEQ ID NO: 80398 - DNA, 601 bp, Human
agaggtttcttcatagagatattagaatcaaagagtatgttcagtagttattctgtcttctttgtaatgaatacccttaagttggcttaacagctcagtacttatctttttttcttttcattcttaaaggtcaagccttgtttttgccgtatatgtaactagagacagtacgtttgaggctaaataactgtagtactagggaatgacaacacgctcacccaagacaccgcagcctggtttactctgtcatgataggaatgaggattgtacatttgaaataggtttctgctattgattttttaaatgtataaacgatggaaactacggaatttctcatgttttcaccacatagttttttgtcataaaatgaagaatatattatatccaagaatgaagaggaagtgaacaaatttgagcaaatttagtccagcaatattttcatttgaatagttgagcccctgaaagccattaatatctctttttaaaaaaagaaccatgcagtatttttgaatctcatcatcgtcacttcactaagtattttcacaatgatgaataaaacataaacaaatggaatgagagattgttaccatggatgattcta

SEQ ID NO: 80399 - DNA, 601 bp, Human
agctttttttgtgttttgtgggttaaaaattcagagggagctctgtgttcaagtttaaatgtagagaaagtacaaaggagagtgtacttatgcacatacacatatgcatgcatgtaccatgactctttttagccttagagaatgaaaccatttaagaaatgagcaatatgtagtattcttaaaaaaagattttgatttccaacaatagttgtggaatgcagcgttcaggggaaaaaggcaactcatggatgatcaagccaccctgcttgtcaggaacccagactcttctatcttgttcttytctgccccacaacatgtgccattcagtccaacctggctgacccagccacatgcatgtccaagtccagtcagaaaaaaaacaaagaaggaagagagctcatctatcccctttaagtacgcttttagaaatctgcacacatctctgctacggccacatccctgtgaccttaaccttgttatatggtaacagctacttgcaagaggggctgggagctgtccttaccctgggcagcaatgtgccccactaaagtgatgaattctgtttccatagcaaaaggggagatttgcagtcttagggaac

SEQ ID NO: 80400 - DNA, 601 bp, Human
tgagcttgaaatagctaatgaaaggaagcatgagtgtcttagtccatctgcgttgctatagaggaatacctgaggctgggtcatttataaagaaaagggaattctttggctcacagttttgcaggctgtctaagaagcatagtgccaacatctgcttctggtgagggcctcaggctgcttccactcatggcagaagatgaaggggagctggcctaggcagatcactggtgagagaggaagcaaaaagagagagaagggacatgacacactctttttaacaaccagctctcccagaaactawtagagtgagaactcactcattgatgaccaagctattcttgagggatctgcccccagacccagacacctcccattaggctctaccttcaacattgggggtcaaatttcaacataaggtttggaggtcaaagaaaagaaactatagcagtgacagattatactgagatatcggtttaactctgaagttcccagatgcagctacttgcagaatttcacttcacacctattaagaaaagtcttttagtttagaaatcctgtgagttacaagttctgcatatataggcagtaattcttttttcca

SEQ ID NO: 80401 - DNA, 601 bp, Human
tctgacattatttcaagatgtaacttagcacctaaaaagtggctggagaacatatcctgtacactcaccaaatgtcacttctttcctctgagctttggctacgacctatgtataagaaaacttagctctccgggccagaacggtgatagtgctcttgataacagagggccaagccgtctgctttggaaccagatgagtgttgcggtgctatgtggcaagaaatgtagatgtttatatgggaaatagatatgtgtctgcctttccaaattcgaaatctttggtcatttagatttaaaaaaawatgtcaaataggatcttttggaagaaataaaaaaaattcaaaatcttttccctcaggtttttctgataggctgaagttttaaatctctaatcatttatctttgatttgccttattgattacattatcactttatcaggaccctgactaaatctgtttgtgtttttaatttctctccattttttcctttccagttacatccttgcatcactattagtgtgattatttcccttcagccatttttgcctgtgaatttctaagcttgaaatttgcagctaactttctccctcctttattaagtc

SEQ ID NO: 80402 - DNA, 601 bp, Human
cctttattaagtcgctgtgataattcttttgggaggcatcgccatacagtggaaaaagcctggattaggatgtagggggtgtcagtttaatctcagtcctgcccttccctaatcatctgcatagcacctgatatatatagcatcagaatgtgaggctcaatgagtgaatagtcttcagcaactcactgaattttatctgagtctcagttgcttcatatgtaatactgtagaaccagatcttgaagttgcatttctatccatccatccatccatccatccatccatccatccatccacccayccatccatcctttccacaagcatttattgagtacttacgatatgctaggcgctgtggcaggccctcatggtccagagatgaattagatagtccctgtggctactgaggtcccttttaactctagccccttgtatgtgaatttccacaattcaatttatactttgttcatttattttcttgctctcagctacttttgatctccttttcccacttttatccatatatatttttaaaagtccctactattgttacatcttttttcacttgtctctctacttgtttctatactcccttaaaata

SEQ ID NO: 80403 - DNA, 601 bp, Human
acaacccaagagagatggtatttactggagagatcatcacttgttgctaatttgatttttcagattctctgagctcttataaaagagagagagcatgctgatgaatgttttcctgccctgactgctttgaggagctagtgtttgctgccctgggcccttagtcctgttatgttttggacttggggatggccactgtgtctaatccactttccattgaggcttttctgtaactggggagggctggatcactgtaggggtggacaaccctgagtgaatgcactgcaatttaatatttatggcyggtacagaaaccatcaagaattgcttaaggatttactgacttggcatcatcaaaaatttatgaggcaggtatgctcatattccacaagcctgcatagtcatagaatgtcgttttatttttcttttgacattatgctttctggagtcttaataactcattaacaactgatgacacactttgctttttggtttaattataaccaaattttatttgccaaaatgatgtttaatttttggtgtattaacccattatgaatatctctcttttcctatgtttactatgactgctttacatttccag

SEQ ID NO: 80404 - DNA, 601 bp, Human
attttaatttatttcaaaaaatacctttagcataaaataaaatttttgaaatgaatgaaaaatgtttatcatgcaacttctataacagagcccctggttgcatttttttgcattatcttctgtgcttgcagtacaggaaagctttttacacacttgtactgagaaagaggatgcaattttacatcctctgtctgtccttaaccttataggacaatagtgagagcatggcaccagttaatcctcgtaactgtagtttgagacaaatttatcattcccaatctaccaatgtgtgaaactgagkctcagtgaattaacagagtggctcaagtttctgtatatgggaagtaaagaactggaatgagactcatctgtctcacttcagagccatactcttcattatacacttctgtgtccctggttgcattataatattccaatttattattttttatgtacataacagtccaaggatcaatatactgtgacttacttaactacctccttattctgaggtgtttaatgattatttcatgaattttttctgaagataaagtgccaagattgggattaatgacccaaagaatgcagtcatttttatggc

SEQ ID NO: 80405 - DNA, 601 bp, Human
atgtcgggagcagattgggtaataaaatgtatattgagaataagacggccttttgaccttttagggtccagggctgtaaagtgtctcagggttgctgccaaacgagccatgaactgggctgggtttttatagttgctgaaaaagagcctaaacactatctgatttgggataaagaaaaaggagcattaaccttgactatgcctttagctccagccacctttttaagaggaaattgctgggcaggtgggggagggctagtcatggaacgaaactgtaagccagaccgggtgtaaggaggagwggtgataaaaggattatagggtggaggagtggaggccgaggaagaatttggacctagcttggcctggtgaggaggggagaggtcagatgggtctgtagaaaaggaagattagaaagacttagcgacgcttggggttgggactgaggggacaggcaggagggaaagaaggaagatttgggatgagttgtactgggaacagagactagggagggaccgatgtgtaaaagaatgtctggacgtcaggcatctcagaccgtttgcccattttatgacaagaattatttagatcttgtaggatgg

SEQ ID NO: 80406 - DNA, 601 bp, Human
gtggatctttctcacagaacaaagagcaggaggacaggggattgatctcccaaggggggtcccccgatctgagtcacggcaccaaatttcactcgcgtccgtgtgaagagaccgctaaacaggctttgtgtgagcaacaaggctgtttatttcacctgggtgcaagcgggctgagtccgaaaagagagtcagcgaagggagataggggtggcgctgttttataagatttgggtagataaaggaaaattacagtcaaaggggggttgttctttggcgggcaggagtgggggtcacaaggtgytcagtaggggagcttttgagccaggatgagccaggagaaggaatttcaccagataatgtcatcagttaaggcaggaacaggccattttcacttcttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctat

SEQ ID NO: 80407 - DNA, 601 bp, Human
agaaggaatttcaccagataatgtcatcagttaaggcaggaacaggccattttcacttcttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctsatcatgattaatagtggaccaagaacaaagtataaaaaataatatcatgttgagataacggcgtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgtt

SEQ ID NO: 80408 - DNA, 601 bp, Human
ttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctcatcatgattaatagtggaccaagaacaaagtataaaaaataatatcatgttgagataayggcgtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcag

SEQ ID NO: 80409 - DNA, 601 bp, Human
tgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctcatcatgattaatagtggaccaagaacaaagtataaaaaataatatcatgttgagataacggygtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcaggat

SEQ ID NO: 80410 - DNA, 601 bp, Human
tccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcaggatgcatctcatgttttgtacttcactgtctttggctgtttttttctttattatttcccattttcttaagttgatccattataaaaacaactccygcttacaggactatttttttccttccagaggcgtgctgttgtttcataggtgaacggatagtgtcctgatggtgtctgtggcccttgaagctgcagtttaaggagggggttcaaagaaatggtagagaaaggtcgtccctgtcctggaaggatgccagataggatgacctttgaaactgtcatcaggggcatgaaaaatgggtttgcaatagttccctgcccttctctgcacaaacgatatacagcatttgatattaaggcaaatatccttttccattgatgatgtgtaatcataaatca

SEQ ID NO: 80411 - DNA, 601 bp, Human
gctgtcaccgtgaaatgtgttaaggcacttgtatgcaaattcaaggggagacatgatattttttatcccaaagtgtagctgtttacaactaattaccaaacacggaacaagcctattgtttgcctttacatgatatatgggcatagaagtttctaaagcaaattctcctctgtcttttcattgattaaattatatgaagtcaccctcttccatgaagcattacatgatgaggtccccaaagcactgaataaagaaatttgtcattaagacactggtgtatttctgatctatatatttttttctgcttcactcgaaaaacttattatctgcatgaaagtatggaaactgttattgtatttaactctctacatgtgaaccttgaagaaatgatggggcgaaggtgaaatgaaagggaggaggtgaggaggtggcacaagtaatgttttcttatggaacttgtagagggataaacctacattagaatcaaagcaggtaattcctgggaaactgaagcatgccattgtggatgtgggtcatgggaactgatgctggaaaaaaatagttcctaatctggtttgggaatggcaaatttggttgccac

SEQ ID NO: 80412 - DNA, 601 bp, Human
tatttttttctgcttcactcgaaaaacttattatctgcatgaaagtatggaaactgttattgtatttaactctctacatgtgaaccttgaagaaatgatggggcgaaggtgaaatgaaagggaggaggtgaggaggtggcacaagtaatgttttcttatggaacttgtagagggataaacctacattagaatcaaagcaggtaattcctgggaaactgaagcatgccattgtggatgtgggtcatgggaactgatgctggaaaaaaatagttcctaatctggtttgggaatggcaaatttsgttgccacaattgaaatattaatatacttctttgtatgaatgccctttcatttatgccttttttttctttaagaggcattttttctctaagacaggctaaacttctgtattcaagcctttagagtttgcaaacatttatcaatagataagaaagatagataaaaagtcctggattcattaatgcacagccatggtctctacagttttgaaatttctcacttgggagaatactggagaagaacctgtggcccgtgaagcatttgactgttaatatttcgtactattcaaatgctttaattt

SEQ ID NO: 80413 - DNA, 601 bp, Human
ttcttttgcttctacatttttgctcgttgtatggatgcattttgtaggactgtgagcttatatttaaaacacctgtgcggcagtggacccttgtcaccgcctggcctctcattcagaagccttagctgttcctcaactcctacaacacatgttgagcgcctctcaggtgccagctactgtaataggcactggggagtggaagggtgacaagatgtgattcctgacctcgagagctttgcagtcactggtggaggaggcacatgtacacagcaaatagggcacgatgtgttgaaggatgaaatgaagcaataaacaataggtatcaagacagcagagataaggacaaccaaggatgccttcgaggagccagggagagcctcacagaggaggcagggcatgcaccgtggcttggggatggaaggggcagaaatagtgttgttttagggaagaggagagcacagactcagaggtcggaggaacgtggcacatctaggagacagggatccaatcccagccctaccacttagcagctgtgtaactttgggaaagtttgctaatcactctgagtatgtttcctcccacgtaaagtagaaatactact

SEQ ID NO: 80414 - DNA, 601 bp, Human
caaggcctcaggaagcttacaatcatggtggaaagggcaggggagccagccagcgtgtcacatggcgagagagggagcaagaggcgaggtggaggtgccaggctctttttaaacaaccggatcttgtgtgaactcattaccacagaaagggcaccaagccatgcataagggactcgcccccatgacaccagcacctcccacaaggccccacctccaacattgaggaatcacatttcaacatgagatttggagggggcaaacatctaaactatatcaaaagtcgatgattaaacacagtctyatataaatgttctacctcaaaaaaacccaaacattgcacacctattatagctaagataaaaaatactgacaacaccaagtgctgccaagaaggtggagcaggccaattgctcatacatctctggtgggatgtgtcagtatcgcaggtggggttgtaagagtagagccatctggaagacagtgccagtggcttatggagttaaacattacacttgccatgtgacctggcaattccactcctgggtacttatttatcctctagaaataaaaatttatatcccacaaaactgtaatgaatatt

SEQ ID NO: 80415 - DNA, 601 bp, Human
tgaggctaggagtgatgagctgatttgcttgttatgcacactggatggagtgtgagctgtgtcagacacgtgaattcagatcctcttgtgccacatcagagggacatgagatggggtggctgtttcacttctgtgagcctcactttccccctcattcatttatgtaaccaatggtgggtccaggttttgtgaggactggagcttacataatttgagtatgggtcttatttaaagaaaaaaatatataggattatgattcaaatttggatacagggtttgaaggagacttgtgacagcgggrgaccctgaggcttatgtgccattagattcatggtaaatctgtccttgctttcaactaatttttatagtgagccactacgtgccgggctgtgtctgcagctggttacatgtgctgagcctaacagtaccatcctggtcctctagaatgctagagcccactgggagacaccaccagaaaacagacaacggcagtacagtcagataagtgtatgatgggggggtatgaaaagccaggaaagatttctggaagagatgacatctaagctgctactcaggatatgtaaaagttaaaatggagaaa

SEQ ID NO: 80416 - DNA, 601 bp, Human
aacactttacttatgtgtacaggtttattgtagaggatacaactcaggaacagccacatggaagagatgcataggacaaggtatgggggtggcgcagagcttccatgccccctccaggtgcgccacctcccagcactgccatggcctcaccagtccagaagctctctgaaccctgtggtttagggttttcatggagcttggttttatacattttagggagacatgagacatcaatcaaatacatttaagaaatacattggtttggtccagaaaggcaggacaacttgaagcaagttgggcrggcagggaggcttccaggttataggaaggtttaaaaattttctgattggcaattggtcaaaagagttattatcaatacccagcattttgggaggccgacgggggtggatcacgaggtcaggagatcaagaccatcctggctaacacgtgaaaccccgtctctactaaaaatacaaaaaaaattagccggacattgtggtgggcgcctgtagtcccagctactcgggaggctgaggcaggagaatggcatgaacctgggaggcggagcttgcagtgagctgaaactgtgccattgcactcc

SEQ ID NO: 80417 - DNA, 601 bp, Human
ttaagaaatacattggtttggtccagaaaggcaggacaacttgaagcaagttgggcgggcagggaggcttccaggttataggaaggtttaaaaattttctgattggcaattggtcaaaagagttattatcaatacccagcattttgggaggccgacgggggtggatcacgaggtcaggagatcaagaccatcctggctaacacgtgaaaccccgtctctactaaaaatacaaaaaaaattagccggacattgtggtgggcgcctgtagtcccagctactcgggaggctgaggcaggagaayggcatgaacctgggaggcggagcttgcagtgagctgaaactgtgccattgcactccagcctgggcgacagagcaagactctgactcaaaaaaaaaaaaaaaagaaaaaaaagaaaaagaagagttattatcaataagaaggaatgtctgggtttcgataaggggttgtgcagaccaaagttttctcatgcagctgaagcctccaggtggcaggcttcagagagactagattgtaaatatttattatcagatgtaaggtctgtgttgatgttaataccggaggttatattgaggcatgttc

SEQ ID NO: 80418 - DNA, 601 bp, Human
gagaccaaggacccagaagcccaggtgtcggcctggtgatgcaaggatggcggcagggctcggggtggggaggaggtggaggtccaggatcaaggcccccagagaagggggatgtcccagatgagagcaatgagaaggacagcttggggtgaagctgaatgccctgagccttcaagcagcaacagattatacctgaaggtagagccacgttagggacgtgggaggacactgactgcttgggtaggggtggggagtgagcatccacactcgagtggctgcagatgccatgagaccctccagrgatgaccaggtcactgttagggcagagaggaggaggcagctttcagaaggagctgggcatgcagagcttgctaaccagtgatggaggatccaggcagtagggcaaagcccatggaggggcccacaggacgggacaactgcgaagacactgtctgccttggaatgcgggcagcatcttcatagccatccagggatttggaccctggccttcctaagtgagagctatactttttctataatttctgccactacataactgccaaagttaaaggtggaaaaagagtctctgtcctagcttttc

SEQ ID NO: 80419 - DNA, 601 bp, Human
gaggtccaggatcaaggcccccagagaagggggatgtcccagatgagagcaatgagaaggacagcttggggtgaagctgaatgccctgagccttcaagcagcaacagattatacctgaaggtagagccacgttagggacgtgggaggacactgactgcttgggtaggggtggggagtgagcatccacactcgagtggctgcagatgccatgagaccctccagggatgaccaggtcactgttagggcagagaggaggaggcagctttcagaaggagctgggcatgcagagcttgctaaccaktgatggaggatccaggcagtagggcaaagcccatggaggggcccacaggacgggacaactgcgaagacactgtctgccttggaatgcgggcagcatcttcatagccatccagggatttggaccctggccttcctaagtgagagctatactttttctataatttctgccactacataactgccaaagttaaaggtggaaaaagagtctctgtcctagcttttcagcgaccttttcaaaaggaacagaaaatcgtcgcattctcttgcttctacaatgccagtgattgtctgatgcatcctg

SEQ ID NO: 80420 - DNA, 601 bp, Human
tgattgtctgatgcatcctgggtttgacaaaggcaggtagacactcacggtgcagggacacgccagttccaaatcgcatctttactttttaaatgttgaaaaacaaaaaagacagtgcatcttagaatttaaggcaacatagtaactaaagtggcggaggcttttaactgaaaccagaagaaacagcatgagttttgttgttttatgtttcttagctgaaagaaactcaggcaggataacgtgataaggaaactcaggtatttgcctgtgattagttcaggaactgttgaaaaaagactcygggattgggcagaactagagtttagatcactagcttgaaggacttttaagtccagtttaagatttggagagagttataaaggctaagccagcatttataagaacatgtaccaattagagaagtacaggagaatttgctgttttctctgttattataaagatcattgttcttaaatttacattagtttgctaggcctactgccacagaaaaccacagactgagtggcttggacaacagatgtttattttctcccaactctgaaggctggaagttcgagatcaaggtgtcagcacaaatggt

SEQ ID NO: 80421 - DNA, 601 bp, Human
ttaaggcaacatagtaactaaagtggcggaggcttttaactgaaaccagaagaaacagcatgagttttgttgttttatgtttcttagctgaaagaaactcaggcaggataacgtgataaggaaactcaggtatttgcctgtgattagttcaggaactgttgaaaaaagactctgggattgggcagaactagagtttagatcactagcttgaaggacttttaagtccagtttaagatttggagagagttataaaggctaagccagcatttataagaacatgtaccaattagagaagtacagsagaatttgctgttttctctgttattataaagatcattgttcttaaatttacattagtttgctaggcctactgccacagaaaaccacagactgagtggcttggacaacagatgtttattttctcccaactctgaaggctggaagttcgagatcaaggtgtcagcacaaatggtctctccctaagcctctctgcttggcttgcggatggctgtcttctccctgcgtcctccctcacatggccttccctttgtgtgtgtctgtgtcctcatctcctctcctcatagggatgccgatcagactg

SEQ ID NO: 80422 - DNA, 601 bp, Human
gaactgacagtcttttgaagttcactttggaggaacctagtccaattatcaggagatattatttgttgaacactttgtacctgctgagcttcttgatatgtgttacgtttacttatcacaacaatcctgcagggtggaattattatcctcatttttttttttttttttgagacagaattttgctcttgttgcctaggctggagtgcaatggcctgatctcggctcactgcaacctctgcctcccaggttcaagtgattctcctgccttggactcccgagtagctgggatcatagggatgcrccaccacgctcggctaattgtgtatttttagtagagacggggtttctccctgttggtcaggctggtcttgaactccctacctcaggtgatccatccgcctcggcctcccaaagtgctgggattacaggcgtgagccaccgtgcctggcctatcctcattttacagaagaggaaactagtgctcagagaggttagacaacatgcccaaggtccccaagtcaataaccaggagccaatagcagggctctgatgatgatgatggtggtgtgtgtgtgtggtgtagtgtatgtttgtgttttca

SEQ ID NO: 80423 - DNA, 601 bp, Human
tattatcctcatttttttttttttttttgagacagaattttgctcttgttgcctaggctggagtgcaatggcctgatctcggctcactgcaacctctgcctcccaggttcaagtgattctcctgccttggactcccgagtagctgggatcatagggatgcgccaccacgctcggctaattgtgtatttttagtagagacggggtttctccctgttggtcaggctggtcttgaactccctacctcaggtgatccatccgcctcggcctcccaaagtgctgggattacaggcgtgagccaccrtgcctggcctatcctcattttacagaagaggaaactagtgctcagagaggttagacaacatgcccaaggtccccaagtcaataaccaggagccaatagcagggctctgatgatgatgatggtggtgtgtgtgtgtggtgtagtgtatgtttgtgttttcatgtgtatatgtgtgtgtatgtgtgcgtgtgtttccctcataccattttgcttatcaaatgatcctttaggttctttccaagtgtatgattttaggtcaaagacaaagcatgacacagttcactgtgaattgtgagttatt

SEQ ID NO: 80424 - DNA, 601 bp, Human
aagtcaataaccaggagccaatagcagggctctgatgatgatgatggtggtgtgtgtgtgtggtgtagtgtatgtttgtgttttcatgtgtatatgtgtgtgtatgtgtgcgtgtgtttccctcataccattttgcttatcaaatgatcctttaggttctttccaagtgtatgattttaggtcaaagacaaagcatgacacagttcactgtgaattgtgagttattatacaagctcgtgaaagagtcggataccttttctgatcctcaatataacctttgtcttctcaccaccataacacrttggtttctcttcaggaactgattttatattctcatgagcacatatgcggtttctcctatagactgtaagatttttaagagcaaggactgggtcttattttccattttgttccctagtgtcttcgatccttattgcattcagtggtttgatttgaacagaactttggaagcatgagacagactctgtacattaaaacgcttccatagcactcaccatggtgtccaaagtgtcactaaatctctgcttgcttgagatttctctatcttaattaatcttgatttgtgctgtttttttgtgaa

SEQ ID NO: 80425 - DNA, 601 bp, Human
ttctcctgcacttactgtacattctcatccatatgttagttgttgttaccataaatgtcctcacacatctgtggcatgtggatgacaagagcttctgagtatattttttaactgtgtttttcgaaggcaactttaagtgctaacaatccagtggttatatgggtggctattgactttcagattcacggcactgttctgagtgggtaattcgccgcctttctctaactcttatgtccttgaggaacctgaatgtacagatgattacctgtacctactgagcgtcctctcgcagagttggggygataaatattctgcaaaacctgctataaaacagtcagccctgagcagcaggaaactgaatatagtcactcacatagctaaacccaggctcaggcctacattcacccctgtccgaagggggtggaaatgagatcatttcacacctcacgtggaagtgcagacctgaaagaagacttggggctcccccagcacaggtgtccccattttacaggtgccaaaggctgtggcggagacagagatggggagaggagttggccgtgatgcgtcgtcatggagcatctcacatgtaagggccatgaga

SEQ ID NO: 80426 - DNA, 601 bp, Human
ttagaatataaaattgggaccttgtctttggaaaggagggagcaaagtgttaacctggacagctttggtgcacaaggtgagaggtttaccaagggctcacacactctccttcatgggagagggtgcttaggaggaggtctggctgctgtgaggtatgggacctgtccaggaccttctactgctacagcaggaacagcactgtgagggagggatgttgctcttcctatttttcagtcgtggaatggaggctttgaaaggtttggtaacttgctcgagatcacacagccagcgaggggtagcrtgggattaaacaccagtcggctcgtctccaaaggcctgactgacaaaaacaaatttcaatcgattttacttttcctctgtaatagatgaggaatatctcatttcagaatatctgaaggtgacatttggagtcgctcattgattcaattattctgaatctttatttcagagcttatttatctcaggttttagatgtggaatgctccaaaactattcattggtttcacttccctttgcattgctaagtaaaggtgatataggagaactactcacaggggtgagcacagcaagggtacgaagg

SEQ ID NO: 80427 - DNA, 601 bp, Human
tttcacttccctttgcattgctaagtaaaggtgatataggagaactactcacaggggtgagcacagcaagggtacgaaggatgtaaaatcagacgcagcttttctatgcatctttcttaaacacattactcttaacccaagagacagtcaggatcattaactttcctaatattttgtaaagcattcatatagcaacatttggggcacatgcgcacctggtcttaagtcagggcaggagtggctaattaattctctgattcctcaggcttcacagtttcaaccagccataattattttgcarttgaggttccctctctgcctaaactggcattgttatcaagggctaaatgcatcagctttgtaataatgaagatgggtgccaattccatcttccatatgggatgaagttggggagagagatggtggagaagcactggtcagactgtaaatgatattgagtagaaagaagtcagggatttttgtttttaacatgaaaaagaaatagaattgtaactaagttgaagtttctttactgtttcatcttgtttctttacaaatttcatcttgtcatttacaagggtttatgccacatagctatgga

SEQ ID NO: 80428 - DNA, 601 bp, Human
gcattctttctggaggtatttagaccttaataaactaccattatcctttaaaaaaggactgaagagaataatatttgtagaaacaaaataatcaaatacagtcctacatcatttaatgttggggatacgttatgagaaatgcatcgttaggcaattttgccattgtgtgaacgtcatagagtgtacttacacaaacctagatggtgcaccctactactccacacccaggctacgtggtgcagcctattgctcctaggctacaaagctgtgcagatgtgactgtcctgaatactgtaggcarttgtcacactgtaagtatttgtgtatctgaacatatctaaacagaaaaggtacagtaaaaatgtggcattataatcttaggggaccaccatcacatacatggtctattgctgattaaaatgtggttaagtggtacatgactgtactagcattaaagttcttccgaactgagagggtggaatgggaacaggtactggcttcttgttttaagggctgactggtgaggaaggtactggcttcttgttttaagggctgactggtgaggaacttgccacacagagcagtaggctcaactaggctg

SEQ ID NO: 80429 - DNA, 601 bp, Human
ttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaatgagstcaagttatttcatccacagtgatagaatgttccccatttgatgcaagcagttaaacttaatttccattaagacaaacacacaaataacaatcctccttcccaaacttgaaatcccacttctctttttgaactctcttcatgaagtagtcccttttcttgcatttacaacataaagcctaaaccacaaatattggagggcaggggttgaggatgagcaattgagatgttcctcatgcccttaaaccaagagtccttatgttctctccttcctaaggatggcttattttcctttccatgaa

SEQ ID NO: 80430 - DNA, 601 bp, Human
tcagcaaacataaactcatacaaatgtttgtcaagctgtgtgagcctaaacagctcattagttgcaagaatgatcagatgggagatgggttgcccaatttggatggtgacctttatgagctctcggttggattgcagatttatgtgtcacagtatattggaacataatgaatcctgtggcatgtggatggtaaaatgcagggcagaaactgtgcaatgaagaggcaggaagaaggtggcaagtccaggagcataagagcagttaatcatctcctttcccccttcccctattctgcttcccytctgttctcggggtgcccattaaaatgcagttggtaatgaaatgctgtttgaaatcaaagttgctgaaacgatattgtggatattgtggaaatctgtcatatttattttaaggatgagcttacttccaggtgctttcagtgactgcagccccgttagttcccatgcattgattctctctcatgtccctgctccagggtaattctcttgtgctcaggcacatgaccttctagttgaaaacctgcccctgccatttctttatgtggctgcggcccagggagcttgcctgccctgcgtgagca

SEQ ID NO: 80431 - DNA, 601 bp, Human
ttgtcaagctgtgtgagcctaaacagctcattagttgcaagaatgatcagatgggagatgggttgcccaatttggatggtgacctttatgagctctcggttggattgcagatttatgtgtcacagtatattggaacataatgaatcctgtggcatgtggatggtaaaatgcagggcagaaactgtgcaatgaagaggcaggaagaaggtggcaagtccaggagcataagagcagttaatcatctcctttcccccttcccctattctgcttcccctctgttctcggggtgcccattaaaatrcagttggtaatgaaatgctgtttgaaatcaaagttgctgaaacgatattgtggatattgtggaaatctgtcatatttattttaaggatgagcttacttccaggtgctttcagtgactgcagccccgttagttcccatgcattgattctctctcatgtccctgctccagggtaattctcttgtgctcaggcacatgaccttctagttgaaaacctgcccctgccatttctttatgtggctgcggcccagggagcttgcctgccctgcgtgagcaggttgcaatgataatggttcccagtgc

SEQ ID NO: 80432 - DNA, 601 bp, Human
ggcaggggagtccccagaaaggagtgccccaaactttcccaagatggggcctactgagattccaaagaaagaagcagtaaaagccggagtgatcaggccaaagcattcattaggggaacttaggcagagtgggctgcagcaatcctgcggcggcagcatgaaaaaaggggtcttccacctagaaacatccacagcgaggtgctcaggggatggagtttacatgagggtttaaggaatttggctcagggccagggccagtttctttcagtgttttgggcaaaagcttagatacctttatcartgtgtgggaatgttcaaggccctggtttgggttcaagcctgctgggaaaaacctgcagctgtctgggtcacagagcggtcaaggcactctgtgagttttggtcacaacagaaaggcaagggctctaggggaccctccagaactacaggctccaatgtcagccccactttcccaagtacaaatttatttcagaaattaaagtactactcttactttttcacacatttcgaagtcatgtgttgacatggatagcctgtctagcacaggaaaactctgatctatttaactgatttaaaatgtt

SEQ ID NO: 80433 - DNA, 601 bp, Human
tcttccatgtggataaaaccagttaatttcctgtggatcttttttgaaagccttattaagaggagggagccctgttttgaacttgtgtcatgagctctgcctgtctctggaggtggcaagggtgctcgtcttcattctggtctgtgtcgcatgctgtcttcctctgtctccctactctttctcaaccttcttatttactattccacacactcgctgggttagacaaccttttctgttgttctgctgaaggttacaatttggagtcgattcctgtagtcttcctttttctattcactttcaraaaagatgttgcaaagtccaagtttcttcctcatgttccgtttctctggggagtgctgtagaagtttccataccttcctgcttctggccttcttagtattttaataactcctgccttgttcccaggtttctccaagtatctggggaaagtagaaacctcagagatggggtctggaaatgtaaaacgttgatgaatttcagggtcacccttgtgaaagctattgattggtcagaggtattctggaaaagtctgcaaaatccagaagctaatttctattttaaaatacaccctataactctt

SEQ ID NO: 80434 - DNA, 601 bp, Human
ctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcarctactattaattgaaagggcattgaagagacatgatgtcacaataaaaagaaaaaaagaaaagaaagcatgtcttcgactttctagtcgtcgtgctttgtatggattcttctttcaaccttgacgaaagggtataattaatctgtaattaaagtcatgatagtttcttaatacgaggaaatgttgtcattgcggttctctgaacacaagagggcgctgtggcaaagcttaccgtctgctcatcctctgccgcaggagggtacaacttcgtgggacaaacttcaaaagaaagatgccattt

SEQ ID NO: 80435 - DNA, 601 bp, Human
gaggctaggagttcaagaccaggctgggcaacatagcaagaccccatctcttatatatatatatatatatatatatatatatatatatatatatttagctgggcatgatggtaagcaaccatagtcctggtcactcaggaggctaaggcaggcggattgctcaagctcaggagtttgaggcttcagtgtgctgtcattgtgccactgcactccagcttgtgtgacagagtaagaccctgtctctaaaaaggaaaaaaaaaaaagagttaccggttatacatttttgagaggagcaatgggkaaatgcaatcatggggtaataataatcaggacaagagcaggggtatgtactgtcccccaccctgctgccctaaatgcgaggaagaagccacgttgctggacccataatgagaagcttcagaaggttgatagagagtgctgatcttgaagacatttagtctgggacacagactacatatcagcatgtcaaacatatcagcttgcttgaatgaatgagtgaatgaatgaatgagtgaatgaaaagtggtgaaggaagaagatggttgggtttgggagaagaatatgcctgaaagatatacaa

SEQ ID NO: 80436 - DNA, 601 bp, Human
tggaaagtctagagtcacagactccttttggactaggctataaatgcatatatactttgcagagcattgcctattagtcgccattctctcctcagagtgtaggcaggttccgagggcagcacctaatgtgggaagagagaatagaaggttctggggaaggggacccactctgggcagagggagaaggataaggaggtggtttggggaagaatcacaattatccttactttaattaatacatttccttggatggcaccaacagcgaacacagccacacactcttctgcccatagtgctaagygggttctctctttgactagaattgtgtcgttgatgtggaagtgcagttgaattcaaacgatctgtagctggtggcttttattcctgaagttcaaatatagacaaccctcttagcaggttctaccatagttagccaaccatgtgttaatctccgcctctttgtcttctgtcttaaaggaagtcaggccaccctaaatcgcggcctctcatgtgtgcctgactgtggagagtgtgattttccagcagtctctgggtctctataatgtttgaatttgcctttggggtgcatgcgtgtggtatg

SEQ ID NO: 80437 - DNA, 601 bp, Human
aaaaccaaagtgaatagagtacttataaaatctggtggtgcactcacaggaggaaatgagttgggagggtttaggaattgtaaggacaagtttactaatgagaaggcaggttaggaatatccttaaggaaaatgcagatgacaaatttccagctgtcaaggaaaacgggttcaacctcataattagatcattcgcgcagagccaaggaactgcaaaacacatggatcttcactgccatgggagactgactctaagaagagaaagttgtcagaggggttctgtgtggaaaatgtaattggartccccaaattatgacttctatcattggaagagggcatcttaaataatttttttttttttgagacagagtcttgctctattgcccaggctgaaggctgaagtgcagtggtgtgatcttggctcactgcaacctctgcctcccaggttcaagcaactctcctgcctcagcctccgagtagctgggactacaggcatgcaccaccacgcccagctattttttttatttttagtagagatggagtttcactatgttggccaggcttgtcttgaactcctaaccttaggtgatccacctgcctgt

SEQ ID NO: 80438 - DNA, 601 bp, Human
gggaaaaagcataaagcaaactgtaccagaaggtatgtgaatggcgaggacacgttggctaatggggccatggtgtagcccattaactcagcttcctaggaatgctcttgaactagtttctatttggaaatgactgataaatgtgggctgaaaaggcccgagagccccaaaatacagcaaggacactctgaaggaccccctctgatatacttgggatgtgtgtccctgcccaaatctcatgttgaaatgtaatcttcagtgttggaggtagggacctggggggaagtggttggatcatgarggtggatccttcatgaatagtttagcactatcccccgcattgtactgtcctcacgatagtgagttctcatgagatctggtcatttaacagtgtgtggcacctccccgcttgctctcttgctcctgcttttgtcatgtgatgtgcctggcctctttttgccttctgccatgaatgtaagcttcctgaggcctccccagaaaccaaggagatgccagcctcatgctgactgtaaagcctgcagaacaataaaccaattaaacctctctttttaatacattacccagcctcatgtatttcttt

SEQ ID NO: 80439 - DNA, 601 bp, Human
actgataccttaaaacagttcattcttttattaatatttattaagcatattctatcaggcaggtgctgggctcggtgctgcagatacagtgatgaacaagacagataggcactctgactgcatggcccatagtctagttggagaggaaaacttaaaacaaagacacagacaggcaattataaattgtgacaagtgacatgaaggaaggtacaagagtgtgaaatggggcacctgaccaggctaggggcagggcacagagagaccgccctgaggaagtgacaagttcagatctgagggacartagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaagtgaaggactttcatctttatataaagggcaatggaaagttgtcaatgtcattgtcattttttttaaatgccttttttactggagtgtaatatgcatgcaagaa

SEQ ID NO: 80440 - DNA, 601 bp, Human
atgaaggaaggtacaagagtgtgaaatggggcacctgaccaggctaggggcagggcacagagagaccgccctgaggaagtgacaagttcagatctgagggacagtagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaartgaaggactttcatctttatataaagggcaatggaaagttgtcaatgtcattgtcattttttttaaatgccttttttactggagtgtaatatgcatgcaagaaagcacccataggggtgagctgggtgaatttcattgtgaacacatcaagcaaccagtaccaaatcaacaagcagaacattattaaccccccaaaagtcacccttagcccttccaagtcctcagcatgttccaaaggcaaccctatcctgactggtaacaacactaggttaattttgaccatttagaaactttatataa

SEQ ID NO: 80441 - DNA, 601 bp, Human
gggacagtagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaagtgaaggactttcatctttatataaagggcaatggaaagttgtcaatgtcattgtcattttttttaaatgccttttttactggagtgtaatatgcatkcaagaaagcacccataggggtgagctgggtgaatttcattgtgaacacatcaagcaaccagtaccaaatcaacaagcagaacattattaaccccccaaaagtcacccttagcccttccaagtcctcagcatgttccaaaggcaaccctatcctgactggtaacaacactaggttaattttgaccatttagaaactttatataaagggagtcataccatatttattctctgtgcctggcttctttcactcaacaacatgagactcatccagattgctacttatagccataaatcactgtgt

SEQ ID NO: 80442 - DNA, 601 bp, Human
gctgttgtggacatttgggtagtgtctggctgtttggaacagtactacaggttgagtatcccttatctgaaatgcttgggatcaggagtgtttccgatttttttttttttcagattttgaaatatttatatgatacttacttgttcagcattcctaatctgaaaatctgaaacgtgaaatgctccaattagcatttcctttgagcgtcatgtcagtgttcaaaaagtttcaaattttggaacgtttcagattttgagattagggatgctcagactgtactatgagctacttgttgattctrtttcacctgatcttcggtgtttttctaagagtggaatttctgggacttaaggtatacatatgttcagcactaatggatcctgccaagcagttttacaaagtggccatttcaatttgtactcccaccagcaatgcatgagagctcccttaaaaggtttgctatagccagtgatgtgatcagatctgtgcttttcaaagaccatatggcctcctgtgagcagaatgggctaaagaggcaggagtgcctggaaggacctgtgggggctgtgatggtaggtcaggcaagcagaagacagggaaa

SEQ ID NO: 80443 - DNA, 601 bp, Human
aaaggtttgctatagccagtgatgtgatcagatctgtgcttttcaaagaccatatggcctcctgtgagcagaatgggctaaagaggcaggagtgcctggaaggacctgtgggggctgtgatggtaggtcaggcaagcagaagacagggaaaggccaggatggaaagaagtacatggacccaggagagatgggtggggaaatggctgatgggctcagggaatgttttgggtggggggcatggtgggcaggagaggggagaggtgacaagaatgaccctgttcaagacataggcaggaaacasatgggtggtctatgattggttagatggtagtgtttgaactctggagatggatcagagatggggaggtgtggatcataattctagtgcattaagagtacataatttgaggtgcattagctatgtccaagtgggaatcaaggaagcaattagatacagaggtctggactcagagtgaagtcccaatggacatgcaaactggagagtcattatagcaatatgggtgagtactatggtttgaatgtttgtgccttccaaaactcatgttgaaatttaatccccaatgtggcagtattgagagct

SEQ ID NO: 80444 - DNA, 601 bp, Human
tagcatgctcagccctctcaccatgtgctaccttgagactctacagtgtccccaacagcaagaaggctctcaccagatgctgcccctcgaccttggacttttcaatctctgtaactgtaggaaataaattccttttctttataaattactcagtttcaggtattctgttatagcaataaaaaccagactaaggcaatgaggaaatgtcacctgggttgagagtagtgagaagaatgtctcattttgttatttcttagtttgagagcagttattcaaattaaagtttgaatatttaaaaaawttttgctcttgattttatttcaagttaaagcttcttaggcatgtgtttatttgtagggcagagatgataacactgttataggaccgacaggttcgtatgcccactgcacagtaatagacccattacatggagacagcaggatttgcagcagaaaaagagttaaaggtcagtgggcaccaagtagagaggggaggagaccctccaatccatcttcccaagttgttctgggttggagtttttaaggggatcatggagagcaaggcaaggtggggggggtgaaatcatcgggatgtggaaact

SEQ ID NO: 80445 - DNA, 601 bp, Human
gcccaggctggcctcatgattagcgccgagtgtgctgcaagctgggtttattttcctttctcccctctctttcttccctgacgaattttatttaaaaaaagtttatagggatggtttcaacaccatgctgtgggcaagagaagagagataccttgttctctgctgcagggcaccacagtcaccaagagtggactttccctggcaacagggcctctgcattggtctgcttgagctgccataaccaaagaccacaaaccgggtggcttaaagaacagacacgcattgttgcactgtcgtggargttagaagtctgagaccaaggcgatggcaagattgcagagctctagggaaggatctgttccaggcttctctccttggcttgtaggtggccgtcttctccctctgtctcttctcatggtcttccctctgtatctgtattagtgtccaaatttctcctttttattagaacccagtcatattggattagggcccactctaatgatcctgtttgaactctgattacctctgtaaagaccctatccccaaataagttcccattctgaggtcccaggggttaaggtctccaacagaccttttatgg

SEQ ID NO: 80446 - DNA, 601 bp, Human
gccagtgaaaatgttctcatcacacgaggcttctgaacacccagaaattttgaagcaagaacatgacaataatcatcactctcattcactgtgtgccatgtccttgcaagttcacagctagcccttacaacagcctgcacaggtctgattttccactctgcttcattgatgagcatctgagacgcgggagcataagggaacttgcttgaggtcacatgcttggtcggtagagactcagggtctgcgcccaggcttgccagcccatctccactcctccctgctgtgggcccagggcacagcrgccacaggaggacttggctcttctttcaggctttgcgggcacagattagctagacagagtaaatatgggcatagcgattgttaacggctaacttttgggtgaatgcactattcttgccatctcaggctgatttatttgcagcactggtagtcagggtccctatagcaagggaagagataatctctaaatattccctggagccatgagaaacggccaggtaaagaagcatccttctttcagctggaacacggcgatgttttctgtcacctcaaatgaggtgatctccagaatcccctcaat

SEQ ID NO: 80447 - DNA, 601 bp, Human
cactctcattcactgtgtgccatgtccttgcaagttcacagctagcccttacaacagcctgcacaggtctgattttccactctgcttcattgatgagcatctgagacgcgggagcataagggaacttgcttgaggtcacatgcttggtcggtagagactcagggtctgcgcccaggcttgccagcccatctccactcctccctgctgtgggcccagggcacagcggccacaggaggacttggctcttctttcaggctttgcgggcacagattagctagacagagtaaatatgggcatagcrattgttaacggctaacttttgggtgaatgcactattcttgccatctcaggctgatttatttgcagcactggtagtcagggtccctatagcaagggaagagataatctctaaatattccctggagccatgagaaacggccaggtaaagaagcatccttctttcagctggaacacggcgatgttttctgtcacctcaaatgaggtgatctccagaatcccctcaatcctgtctcattcattcaggcacaaaaaaggagaaacgtagttgacaggaattagatttggaaatctttcagagaaa

SEQ ID NO: 80448 - DNA, 601 bp, Human
gagaaacatgatgcgttcagggttagccaccttgcttgtgaattctagaattctgccagcctcacctgagagcccctcagaagtaagaggggcttcttactgtggaggaagtgtcagaatgccaaccaaagatggccagctaaataaatgacatgcctggtggtctgacatgacaaatcctgagggtcccttgcccagggtgggtggcaggggaatggcagttcacattcaagatctaagttttgagagatgagaatcatctcctttggggtggggcagctgcattccacactcgggaccyggccactcagtgcggggtgatggtgcagttcccagggactgatgtacctgctctgcagtggcaacctccgagtgtgagagaacccagctcttttttggacaattttgcatctgactcattgttggtatttgataacatttgttatgctaatataacaaatacaataacaggaaaatcagaaaatccatgtgtactcaatgtttagctcccacttataagcgagaacgtgcagtatttggttttctgttactgcattaatttgcttaggataatggcttccagctccatccatgctgctac

SEQ ID NO: 80449 - DNA, 601 bp, Human
tgaaatgccattttttcactcctccttcccccaggctctaaataccattgctgaattgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttccttyctttctttctttctttctttctttctttctttctttctttctttctttctttcttctttctttccttctttcttttctttctttcttttctttctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccag

SEQ ID NO: 80450 - DNA, 601 bp, Human
aattgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttcctttctttctttctttctttctttctttctttctttctttctttctttctttcttttttctttctttccttctttcttttctttctttcttttctttctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccaggatggtctcgatctcttgacctcgtgatccacccacctcagcctcccaaagtg

SEQ ID NO: 80451 - DNA, 601 bp, Human
tgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttcctttctttctttctttctttctttctttctttctttctttctttctttctttctttcttctttctttccttctttcttttctttctttcttttctttctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccaggatggtctcgatctcttgacctcgtgatccacccacctcagcctcccaaagtgctg

SEQ ID NO: 80452 - DNA, 601 bp, Human
atccacagggctgctgctgctgagcacccatgcccttgggtgacccactctcctgctcaggggcccagaggatgcttctttcttcttcctgggcactttcccctgagttttggtttaaaagatagaattcccgatgaagccagcttgctgcagtcctgtagccccacatctccatatgcgatcctttgagggaggctgagcatccctgcatctctgaatgggagacatgtttccaccttggctcctgggggcactggggccattttcctggtgttctgagcactctttctgcagaagaagrcactctcagatggtagattttgtggatttcagtaagtagagtccttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacacgccaccaagactaagactgaagcctaggcaagacttagagtatttgtggcttcagagaaacatcaaattgagaggaagatcgagt

SEQ ID NO: 80453 - DNA, 601 bp, Human
gaatgggagacatgtttccaccttggctcctgggggcactggggccattttcctggtgttctgagcactctttctgcagaagaagacactctcagatggtagattttgtggatttcagtaagtagagtccttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacaygccaccaagactaagactgaagcctaggcaagacttagagtatttgtggcttcagagaaacatcaaattgagaggaagatcgagtgataggaaaactgaagccagagaagtaagtattttgtatgtagagtatcattttccaatcatcgctggtgtgataaaacagcaaacgtcactgcttattgaaagcaactagacagtatgtttggtgattggattacaagttttccttttagataaggagagatttaatctgtttctggactctttaggagcacccttcccagttttacagttgag

SEQ ID NO: 80454 - DNA, 601 bp, Human
cttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacacgccaccaagactaagactgaagcctaggcaagacttagagtatttgtggcttcagagaaacatcaaattgagaggaagatcgagtgataggaaaactgaagccagagaagtaagtattttgtatgtagrgtatcattttccaatcatcgctggtgtgataaaacagcaaacgtcactgcttattgaaagcaactagacagtatgtttggtgattggattacaagttttccttttagataaggagagatttaatctgtttctggactctttaggagcacccttcccagttttacagttgagggactggagaccctgagaggtgaaggggcctggctgcactcacagtggaagtgatcccactggatctcagatgttgagtttctgacactcaatctagagctcttcttaccacacatgcttcagtctaca

SEQ ID NO: 80455 - DNA, 601 bp, Human
ggtgctgtgttcagcatttttaatttttttaatagttaatgctatgctcacattttcctcccgtgacaaagagtgggaataagcgtggcacatgtgtctctcaccatctgtttgatagctgcacagaagccttaggaaactgagggatagacacgctcccactgagttactcaacactgctgcttccttgtcctctggctgaaggctaaaccctgccttctactgtttacaacaggagtgtccaatctttcggcttccctgggccacacttgaaggaggagaattgtcttgggccacacawaaaatacactaacactaacaatagctgatgagctaaaaaagaaaattgcaaaaaaaaaatctcataatattttaagaaagtttacgaatttgtattgggccacattcaaagccatcctgggctgcatacagcctctgggttggacaagcttggtctaacatatagtgttaataggatatttgaggtggagtaagaccaatagatcaggaggtaattgccactgaaaacatagttaattactcacagatcctgtgtcatgccacgtgaggaagcaccagggtgggtcaggagacagacgga

SEQ ID NO: 80456 - DNA, 601 bp, Human
gtggtgtccaagtagtgccttcatggctccctcacttataaactgtgtccttgagtaaactgctgaaccctgtggtgccttggtgtcctcaccaataaaatagaggtaaagatacaagctcactggtttcctgtgaggactaaagaacacctgtgaaaagattattaactatgttagagaggagggtgatgatactaattggaaacaaataaggtactaaaacaagtgagacgtgatcttcactctgatggaatccagtgggggaaatgaatataaaaacaggcaattataaaaaaaaaaatggtaagtctgctgatatggagtacactttctaggggcatcaggatagacaaacatagaagaaaaataatatttgatttgagccttaatggataaataaataaataaataacggggagaaagatgattcctagagtagggagtatctcatgcaaatgactgagaagcttgattaagttaatgtttaagaatgtggcaggccaggtatagtggctcatacctgtaatccaagcactttgggaggccgactcaggtggatcacctgtggtcaggagttcaagactagcctggccaaaatggc

SEQ ID NO: 80457 - DNA, 601 bp, Human
agaccttggatcatgtgtatatgtgcggttaataaaattcgatagtctagaaagctttaaatgcaatataaagaggactatcttagttgagcaggcacttattaaaattctcagcataaaataacagagtataggacagaaaattatcttggaaatttaataaaaggttatatattagtcagctcctgctttgataatgtagtataacaaacagcccccaaatctcagttgtttatatgaaagcatgtatttcttgctcatggacttgtgcgtcatcttgtggctttgccatgtgtttgtrggttgggtcagatctactttgagtaattctgggactgggctacctgcggggcatgctattctcatggtagactggaggaaggaagatagataggaagacaatcatacaagggcatataaagcctctgggtgggcgtggcatacgttaggaccactggtgttccattggcaaatgcaagtcacctggtcacatccagaggcatggggagatgacgcttactctgcctgtactgaagagaaaggagagaaggaggacttatgaacaatgaatacaatctaccactgatggtcattaatggcc

SEQ ID NO: 80458 - DNA, 601 bp, Human
atatgttgtaaattcagatcaataaggttttaaaaattaaattattgttttctttcctgggataaactctattattctttaccactgtgctagatttttttttttactaattcttaaagcatttttgcatccatattaataaatggaattaactgtaattttgtttcttcatactatctttccccgttttggaatcaaggctgtaccagtctcataaaataactgggaagttttccatcttcttattctccctgggcatcatcctcacctacctgaactactgcagttgcctcagaaccgrttttcgccctctcatccttgtcttacagtacacctttgccccaaattcatttcctacaatgcagtgattcttctaaaatacgcatcccttcatgctgctccctggtctagaacacgtcacagttcatggcttattgtcgtagctcagtaattccttgttttctggggtttctctagcatcatacaggctgaaatggtgtcatgtgattccagaggccaaaaggctggtgtggagtcatggcaactttcctaccactacattcccccttcctatgagtttcatcgtaccaatgatggctgt

SEQ ID NO: 80459 - DNA, 601 bp, Human
gatgttgtataagtggctcagggacccaaaatatcttctgtggtgacccttgctttaaatctcagggctatgttttcttagactgtctgagcaccagtttcctcatagaatgtggcagattgaggaagattgtatctaaagcaccaacatagtgtctggcaccatgtcgttcagtaaatattatacctgtgaaatacatcaaatagaggcgccactgctgggaagtgaagtcctgcctataattgagtttaacaattccatagaagatttttttgaatactgatgtgcaaggtgactggcytcatgtcagattctgtgagtaaaacaaaggtaattgagcaatggttcccacccttctggcatcactgactgttacgggatctagaaacatacatgatcagacacgtgaacccacggggccaacaccacagcaggagtgaagaaggagctggaaggggaaggtggggattcagtttgcctggcagggcatggtaagacttcagaaaggaagtgacattggaggtacatcttgaaggatgagtgggatttcaacagacagaggctgtagggctgagcacttgaaacagagggaggacatatt

SEQ ID NO: 80460 - DNA, 601 bp, Human
taatagtcaaacctgatatagcttctttgtcactgtgtcttttccttgaaatgaatggagctttttgattttttatccttacttttctcctctctgggttacagtggcaggttgttttatcttcccctgatgaattgaccggtccagagagcatttcagttatcatttatggaacaaggccaaaatatttctttcacacatacagcgcagactaaatcgtctttttctttatcttttttttttcctttaacaacctccagcctatttgtggcatctgaaaaactttgcggcagcattttayagccatttattgtagagtctgttgctttgggctgctgtcagtgctctgacacaaagtttcccatctgattttgagctggtcaccgtgtgctgttgtagtaacagggcctcctggtgcattgaaacacctggtttacttcacacttgatcactggcatgttcaagaacagatagagctttgtctgtcatttgctctttttgggttagcttaagctagggatgttttattttaggtttttttcttaaaatcagagaaaatctagcttcaaaactcaagtgctaaaacaccaaaatagtgtta

SEQ ID NO: 80461 - DNA, 601 bp, Human
ccagagagcatttcagttatcatttatggaacaaggccaaaatatttctttcacacatacagcgcagactaaatcgtctttttctttatcttttttttttcctttaacaacctccagcctatttgtggcatctgaaaaactttgcggcagcattttacagccatttattgtagagtctgttgctttgggctgctgtcagtgctctgacacaaagtttcccatctgattttgagctggtcaccgtgtgctgttgtagtaacagggcctcctggtgcattgaaacacctggtttacttcacayttgatcactggcatgttcaagaacagatagagctttgtctgtcatttgctctttttgggttagcttaagctagggatgttttattttaggtttttttcttaaaatcagagaaaatctagcttcaaaactcaagtgctaaaacaccaaaatagtgttatagaggcacattcctggggcaggggagaggtggccctcgattaaatatatacgagcaagtatttattgaatctcattttaaggacatttgcatttcatgagaagtgagaggtgtggttgctgccctcaagagacttataacag

SEQ ID NO: 80462 - DNA, 601 bp, Human
ctgccatgggaaaaattgtgtatgccagatgcattttgttcatttttaaagagctcctcaatgctattgctgatctcctagggtaagagaaggacagggaggttagacaaggcaactggtagtcttctaatgcctacagtaattaatgataatattcagactagtttcattcatcaaagcgtatacattacagggtttgaaaaataggcgtattttcttagatgcaacaaaatctactctagctgctgcctcagggtgctcattaccacctttctagtctgccatgggtttggttgtgggrcagaagtcagccacatacagaacctcaatggcaaggcaatatgggaagtgcagtcctttgctttaagtctctagtgtagagaaaacatgttttgggggtggaatggtagactggagtgggtttgaataaaccaattggcagtaactgctgcagatagttctcaaatgttattgcttccaatggggtgaactaagtcatgcagtgagccaattctcttgcaaatggctggcctgtcttcaaacggctatcagagaaacgtcaatttcagaatatggttagatacagtgtatggggataatt

SEQ ID NO: 80463 - DNA, 601 bp, Human
tgaaactttttgaacaccaacatgatgctcaaataaagtgctcattggagcattttaaatctgaaacactttggttgcaagcattttgaatgaaggatgctgagcctgtatacatatcatagcaatctctgtctccattgtgtgttccctccctgtgtatcactgtgtctttgtatctcttcttcttctccttctcctctctcttcctcctcctcctcttcctcctccaccttttctctctctcattttttttttttttgacagagtcatactctcttgcctaggctggagtgcagtggtrcaatcatagctcactgtagcctcaaactcttgggctcaagtgatcctcccacctcagcctcctaaagtgctggggttacagacatgagccatgatgcctggcccatttttcttcttaggtggataccagtcatcagatttagagcctcccctaatccagtatgacctcctcttaatgaatgttatgtgtgaagacctcccttatttccagataaggtcaccctcacacgtactaggagttaggacttcaacaatttaacccattataatcaaagagcctataagactgtagatttacatg

SEQ ID NO: 80464 - DNA, 601 bp, Human
tccttcctttcttcttctttttcttcttctcctcctcctccttctttccttccttccttccttccacccccgtttctgtctttcttcctttctttctgttcttcttttgataggatcttgctgtcacccaagcttgagtgcagtggttccatcttggcttactgcagcctccacctcccaggctcaagtgatcctccctcctcagccacccaagtagctgggaccacaggcacacaccactatgcccagctaattttttacagtattttttatagagatggggtttcactgtgttgcccargctagtctcaaactcctgagctcaagagatccaccagcctcagcttcccaaaaaagcatcttgtttttactcgcatgctttgtccctctgccaggacagtagctgtaatcccatctttgccatctagcttgcccccagtggctggtggggcacaagttttatttcttgataaggctgtcatattatggctaatgcttataaatgcttcatgttggggtagagtggaaattgacactttcagccatgaagacctcaaattttgggactagctagcctgtattgcaggctttggtgaagcca

SEQ ID NO: 80465 - DNA, 601 bp, Human
ttggggggctttgtagcatcaacgggtcagaatttcttagaggcattcttactttttaggtctcaaatctctgtcatttttcccttacggtatttgcacagtgcagcctgccttctgtgacctacagaagcacattgcatttaacctgaggcttatttgatattacactttttttctttccttcaaatatccacaatctaaattgtgttcagaaagttccgaagagctgtaatcccagcactttgggaggccgaggcgggcggatcacgaggtcaggagatcgagaccatcccggctaaarcggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagttccgaagagttgccagggctctatttaatccattgctcttcttagcaatgcaaattctgtgcacaatgagtttattctccttgagaagat

SEQ ID NO: 80466 - DNA, 601 bp, Human
tttcccttacggtatttgcacagtgcagcctgccttctgtgacctacagaagcacattgcatttaacctgaggcttatttgatattacactttttttctttccttcaaatatccacaatctaaattgtgttcagaaagttccgaagagctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctactygggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagttccgaagagttgccagggctctatttaatccattgctcttcttagcaatgcaaattctgtgcacaatgagtttattctccttgagaagataaattcagtttggctccagtggctaaactttgttggacaagtttattcctgtgtgacacctacctggccaagcactgt

SEQ ID NO: 80467 - DNA, 601 bp, Human
tagtactctcagttaggagaaaaatatctcttttgctctgaggattcctcagtatttttagtgactctttgcatgcttgcaagggctgtgagaacaagcccagcaggaaggaagagacatggggggaaggaaggaacgtgagggaagtgagaagaaaacaaaggcaaagtttcatacctggaaggcttcgtgcaccagcgcccacctccggaaaccacagttgcaaatattcttttgtgacctaattttggttctaggtttcctttcctctgtatgtgtttgctacattccattccctatrcaatagagtttttctgtaaagaagtttccaagtataaccttccatgaagctcctcaattttaagaatttataattttccagtcctagtgcttaactcatccatcatttgttttccctcatattttacctgtttggttgcactcaaagtcttcgttgatggatgaaacctgatggtttttaagaagcagaaaataccagttttgtcctcactgattgatttttcttgacagatcacgagtataatttataccagctcagtggcactaatcttgttttgttgttgttcttaaaacagctttg

SEQ ID NO: 80468 - DNA, 601 bp, Human
cagctcagtggcactaatcttgttttgttgttgttcttaaaacagctttgacaataagctgctactctgactttgattcttaagtcagcattaatgaaacaccattcatttgtgttatcagctgtaatagtcaaaaacaggtttaagactttaccatgcttgctttcaagttttgggtggatttctttttcctccaatgcttaaaaggtttagtaagtgaatgtcaggtcaaatgggcgtagctgagtttctcccaggcacgctggctttcctgtggatgtttttgtcacagcagtctaartgtatgtctttctggcccggtcagggaactttgctgtggggatttggtttaaattcatgtttaatctcctaattttatttttgtggctatagtgcctcaccgagtatactgaggctgagactggacagaaagaccttttttctgataagctcttaatctgtatcaggctcagccaaaatgagttctgttagggctgctatttttagctatgtgtaatagctattgtggtctcacaatacacttgtttatacacagaatatggttttatgcacagaattttgtgtattaaaataataggca

SEQ ID NO: 80469 - DNA, 601 bp, Human
attccactgtgtgaatgaaccacatctccttcatccgttcatccatagatggacatttgggttgcttcccgcatttggctattgtgaacgatgctgctatgaccactggtgcataggaataattttttagtgtaaatatgtcccatgtaattttagtacatacttttatactaaaaaattattcattgtttatctgatgttcaagttaactgggcaagttgtgttttattttattgggtaatgctacctggttgagaaccactgccctaggactgaactgctattttttttttttttttttgagatggagtcttactctgtcacccaggctggagtgcagtggcgtgatctcggctcactgcagcctccacctcctgggttcaagcgattcccctgcctcagcctcccaagtagctgggactacaggcatgcgccaccaagcctggctaatttttttttttttttgtattttagtagagacggggtttcaccatgtgggccagggtagtctcaatctcctgacctcgtgatctgcccgcctcggcctcccaaagtgctgggattataggcgtgagccactgcacccagccagctggactgc

SEQ ID NO: 80470 - DNA, 601 bp, Human
tttttttttttttttgagatggagtcttactctgtcacccaggctggagtgcagtggcgtgatctcggctcactgcagcctccacctcctgggttcaagcgattcccctgcctcagcctcccaagtagctgggactacaggcatgcgccaccaagcctggctaatttttttttttttttgtattttagtagagacggggtttcaccatgtgggccagggtagtctcaatctcctgacctcgtgatctgcccgcctcggcctcccaaagtgctgggattataggcgtgagccactgcacccrgccagctggactgctttctttgcttgggcactggctcagggctccaaggaccgtggtcataccttcccatgcaacttacatatgacttccaagacttccagcacagtgaagagcacatggaaaaatgtgggcaccataacatctacataccctaaatgtgtcagtcagcttcaatttgttctcagtttgggaagggtgatagagatactgacccttccttttgacctgcctcttttccattttattctggtaaattcacgcttattacagcacttacagagcaaatcatattatgattat

SEQ ID NO: 80471 - DNA, 601 bp, Human
agcacttacagagcaaatcatattatgattataattttatgatatcatacttttatattatgaatatatttataatatgtgaaattatgattggattcttcaaaaagtcaacttaaagaaacaagttgggatcctcactggctacttgtgtcctatttcaaattatttctatttgccctttctgctcctctccccagctttattgaggtatgctggacaaataaaaattttaagtatttacagtataaaatgtgatgatttgatgtatgcatatgttgtgtaatgattaccacaatccagytaactaacatgtctatcacctcactagttaccttttttttttttttttttttggagtgtgatgagaacccttgagatctactctttgggcagttttcaagtatatgacacattgttattacatagagtcaccatgctctgcaatagatctccagaatttattcatcttgcataactgaaactttttaccctttgatcaccatctgcctttttgctttttctatcactcagagaaagccagttagtggataatttctacatgattgaggttaatagaatgcggccacctaaaactgtccct

SEQ ID NO: 80472 - DNA, 601 bp, Human
ttatattatgaatatatttataatatgtgaaattatgattggattcttcaaaaagtcaacttaaagaaacaagttgggatcctcactggctacttgtgtcctatttcaaattatttctatttgccctttctgctcctctccccagctttattgaggtatgctggacaaataaaaattttaagtatttacagtataaaatgtgatgatttgatgtatgcatatgttgtgtaatgattaccacaatccagctaactaacatgtctatcacctcactagttaccttttttttttttttttttttggagtgtgatgagaacccttgagatctactctttgggcagttttcaagtatatgacacattgttattacatagagtcaccatgctctgcaatagatctccagaatttattcatcttgcataactgaaactttttaccctttgatcaccatctgcctttttgctttttctatcactcagagaaagccagttagtggataatttctacatgattgaggttaatagaatgcggccacctaaaactgtccctgaggcttgggaatttgggtgaatcctgattctgccatgcactttgggcaagt

SEQ ID NO: 80473 - DNA, 601 bp, Human
tggtggctcacgcctgcaatcccagcactgtgggaggccgaggcgggcagatcatgaggtcaggacattaagaccatcctggctaacatggtgaaaccccgtctctactaaaaacacacacacaaaaaaaaagttagctgggtgtggtggcatgcgtctgtaatcccagctactctggaggctgaggcaggagaatcgtttgaactggggaggcagaggttgcagtgagtcaagatcacgccactgcactccagcctacgcaacagagcaagactctgtctcaaaaacaaaacaaaaaaaccaaaaaaaaaaaaaaaaagaaaaagaaatccgttttcgctgagccctcctggcaggtagtaaaatcttggacttgagctccctggggccctgtccagttgccctcagtgccctcccttccagcttacccatttaccaggtgttcgaggctgctgccagtttaaattttgtttcaaaaactggccttctctttctttttattctgcaacattttgccttggggcctagaaaggaatccttagtcactgattgccgtaggcggatattacctcacccagtatgggcttccacgctaaagacc

SEQ ID NO: 80474 - DNA, 601 bp, Human
ctgcaatcccagcactgtgggaggccgaggcgggcagatcatgaggtcaggacattaagaccatcctggctaacatggtgaaaccccgtctctactaaaaacacacacacaaaaaaaaagttagctgggtgtggtggcatgcgtctgtaatcccagctactctggaggctgaggcaggagaatcgtttgaactggggaggcagaggttgcagtgagtcaagatcacgccactgcactccagcctacgcaacagagcaagactctgtctcaaaaacaaaacaaaaaaaacaaaaaaaaaaamaaaaagaaaaagaaatccgttttcgctgagccctcctggcaggtagtaaaatcttggacttgagctccctggggccctgtccagttgccctcagtgccctcccttccagcttacccatttaccaggtgttcgaggctgctgccagtttaaattttgtttcaaaaactggccttctctttctttttattctgcaacattttgccttggggcctagaaaggaatccttagtcactgattgccgtaggcggatattacctcacccagtatgggcttccacgctaaagacctctcacaaacact

SEQ ID NO: 80475 - DNA, 601 bp, Human
ctgaaagttagcgctgtggctttcaagatcctcctgtggcgcctttgtatatggcatagaatggtgccaactggagtagcctgagaaccagaaacaagaattctgcttctgaacagcttcgtttttgggccagagaattgtttccaccagaggaggcgtgatgggagcttaggggctatgtgctcggtttctgaagttgtacaacggagcattcatttgcattcatttgacaagtcctgctgtgttcctttacttgttctcttctgtattatgggcttaagggtcgcttatttcaacatckctatattttccctgaaagctcagtaatgattgaatcacagaatttaaagagcttgtcgtataaatacatctaaagtgaaaaagatgaactttttccccagtgaatacaggcaaccatcaatcaaaggaatgcatcctggaaaagaaaggcacagggtaaagcctgcctcctttgcgggtcccatctgttcttgggaggacagtccccatgtattgctcctgggccctttgtggccgagcacgaacagctgtacatacaaaggaggctgtgtgtttgttcatgatgttggaaccggaagtg

SEQ ID NO: 80476 - DNA, 601 bp, Human
tgaagatggaggcggagacagtagtgaggcatctcaagccaaggcatgctacgggttgctgacaaccaccagaagctgggagagaggcacggaaaagattctccctcagagcctcagaaggaacccactggactaacaccttgactttggatttctggctgctgggacaatgacggagtaagtttctgtagttttaagccacccagttttcgatactttgtcatagcagcattaggcaactaattccatatctcacccataataaacactcagtgctagcaattggctgccactgtggtgmttatcagcatggaactatgtgttcctgaagagaattagttattccatttctatgaatattttcaacccaagattgttgctctcagttaacgtactgaaaatgaacttggtgaaaaagtaaaagctcttctacatatcccatttgtggatagacttaagagaacagaaagcttattatggaataagcaaattaatacctttgggatcaatagagtgtctacagttcaaaaccctatcaaaagtgggtttacgtaaaaaaaactagtgtgttatccatgtgtaatattttgtataatataca

SEQ ID NO: 80477 - DNA, 601 bp, Human
taccatttgggattgactcttagctccttacatgcacttaagcagccattcatgaccttttctgcagctcaactgatacactcaaggctgggcatgtccttctgttctagtcattctgcttttggtccacttctatatgtttgttaccaaactagacattgtcttcaagacccactctggccaagtcctggggtcatgtttagtcctggaaggacctccaggagatggaggtagttcttagttgaccagaggggagcaggaccacctgtgctttaaggtcatcctgatttcctggtggtcrttaatacgaaagaagctacaccaggcttgacttctctgagtcagtggtgttcagagcccttgactcaccctggacctgggcttggcaggaatttctctaaccttaggtggatgtatgggtgagtctgcacagcaacttactgttctggtgcatttgtgttggcatgcccatgtaccgggagatgccctagggacttacttatgacatactgacctagagagggtttgcgtataaaattttaacttgactcactggttcctggcagggtcaataaatatttgtggactcactgagtgaatg

SEQ ID NO: 80478 - DNA, 601 bp, Human
tgtccttctgttctagtcattctgcttttggtccacttctatatgtttgttaccaaactagacattgtcttcaagacccactctggccaagtcctggggtcatgtttagtcctggaaggacctccaggagatggaggtagttcttagttgaccagaggggagcaggaccacctgtgctttaaggtcatcctgatttcctggtggtcgttaatacgaaagaagctacaccaggcttgacttctctgagtcagtggtgttcagagcccttgactcaccctggacctgggcttggcaggaattkctctaaccttaggtggatgtatgggtgagtctgcacagcaacttactgttctggtgcatttgtgttggcatgcccatgtaccgggagatgccctagggacttacttatgacatactgacctagagagggtttgcgtataaaattttaacttgactcactggttcctggcagggtcaataaatatttgtggactcactgagtgaatgagtgagtgaatgaatgaaccagtctgctaagaagtgtgagcacagaatatgtgtgctgttctgacacatgatgaccctatcatcctttgaggac

SEQ ID NO: 80479 - DNA, 601 bp, Human
taccacccgagcatcaccatagtgatggtgttgaggataaaaatgatgacaatgacaacagcagcgatgataatagttaaccattgtcgagtacccattatttccttgactccttatagacactctgtgagggaagtaatagtattgtcccaattttcagaggaggaaatgaggtgtagagatgctagttatcttacccaagctcagttgactgtgctggtaagttgtgaagttaacctaggttagcctgagttcacaggctatgctagattaacttcagctagccttgcttttaaccacytacactgacagcctttcaattgtaagaggagctttgggtttttgctttgaaagtagaaacaagtatctagtgataataatatgcctaataattatcctgcacaaaataaataatccagccacttatcaccacctctaaggcaccttctcatcctgtcgttttaaggttttgttcttttggttctgtccccagccaggttttcttttccctccacatgcctggtgtggtgtgagtaaagcatctgccattttgattatggcacacttgctacctcttcttaaaacattcgttctcatccct

SEQ ID NO: 80480 - DNA, 601 bp, Human
taggctggtcagttatatagcgttgcttccctgcaggtgaggtggcatgtgacagggtagggtaggtctgacacccctgcactctctctacccacaccgtgaaaaatagtgagacaacagcattgcattcttcattttgaaagaggtttgaatgtttttatttgtggaaggtagatgtcatgaagagttgcataattaaactagtacagaggaaaaactggcagagaagtgagttgcagggctaggtttacatacaggatgacaaacctgtctctaaagatcccgggaactgttgtcacawggtgacagcttatgatggtggctgaggacactgctctttacctttgtgtctcttgtctcgtctctgaatctcaatacctgtaattaagaaggagcccataggagttttatccatcttattttcagatatttaagcagaataaatatattttcacaatcctttgaaactctcttccttcttaaaccttaatgagattccaaggtagcaacaaaggcctttctgatattacctgtacaatcaaaaactgagcttgaacttcctataatttcttctttttggtcaaaggagtcaccctccaac

SEQ ID NO: 80481 - DNA, 601 bp, Human
tgtgagacaaaaattacactctaatctgcagttgaacaggttctgtcttccattaaacctgtatccccattttattatatagttgagccagttatatatgactcactgggaaagtgcattttatgatcttgttagaagaaatggtttctctgggatccttttaagccaataattttatacctagctcctcctaaatatctaggacattaacttattagccattccggtgtcaagcctaatgctttttaaatacttaaaacaaataccaggaaactgtgggggttggagaatagattttccrtaggcatttagtgctttcagagatcagggggatcgatctcaggggatttagtaggaaaagacttgattctctgcttcctctgcacacagagctttcattttatgcaacaggagggacagcatgcatgtgggataaagccaggctgattatttcaaaaccaggctcacatctatttgactgacaaggtcctggcccccggccagggttacagcaccggaacatggtctcttctctgcggctctgctggctgggcctgtgtggaggcgggtggatggggggatgtccaggctgcagctgaca

SEQ ID NO: 80482 - DNA, 601 bp, Human
tgtgttaaaaacacatctaaccctacatgttagaaactctgccagctgacaaaaccagaaaccttgagtcagtctggattctttcctctctgttttattcattgtgtaatctcaactccatcaggtcttggttgaaatgtcagcatctcaaatgggtcgcctccgaccacccaatttaagatgacagcccccctcctacacgtaatcgtcctttatgcttatcagcatcagtgtattgtatgtttacttaccactttgcttattattagctgtcttccctcttggaatgtcagcacatatrtgttttattgtattaattctatttaataagtagtaatagagtggtttccaagtgtcaggaactgctctaagcatttttacaaatatccacttatttaatgctgttttttcaccgtcatagctctagctgttagaatagtgcctggcatgtagtagttgctcaataagtagttgttgagcgaataaatgaataaatgaatgactccagcctaacacgaagtcctgtcaattctatttcctaaatacctttcctaacaacccacctttctccatctgtaatgaactaagaaagtggccgtat

SEQ ID NO: 80483 - DNA, 601 bp, Human
ctggattctttcctctctgttttattcattgtgtaatctcaactccatcaggtcttggttgaaatgtcagcatctcaaatgggtcgcctccgaccacccaatttaagatgacagcccccctcctacacgtaatcgtcctttatgcttatcagcatcagtgtattgtatgtttacttaccactttgcttattattagctgtcttccctcttggaatgtcagcacatatgtgttttattgtattaattctatttaataagtagtaatagagtggtttccaagtgtcaggaactgctctaagcrtttttacaaatatccacttatttaatgctgttttttcaccgtcatagctctagctgttagaatagtgcctggcatgtagtagttgctcaataagtagttgttgagcgaataaatgaataaatgaatgactccagcctaacacgaagtcctgtcaattctatttcctaaatacctttcctaacaacccacctttctccatctgtaatgaactaagaaagtggccgtatcattctcctttgtagggcccttgaatggcttccctttgtttgtgggagaaaatccacactcctgcagggattc

SEQ ID NO: 80484 - DNA, 601 bp, Human
cctttgtttgtgggagaaaatccacactcctgcagggattcacacacgtttcttgtcatgccctcagttttctgcctccatctttatttctcaaaactcccctctcatcctctcttgccttccttacatgctaatcttcaatcagcccggacattcagtttccctaatatgtcccatcctccctcttcttccaagcccctgagtatgagctccttaccattggcattccttcctactacctgccctgttctctgcttattctatttttttttttgagatggagtcttgctctgtcacctargctggagtgcagtggcgcgatctcagctcaccgcaacctccgcctcccaggttcaagcaattctcctgcctcagcctcccaagtagctggaatcacaggcacgtgccactgtgcctggctaatttttgtatttttagtagagatggggtttcaccatgttggccaggctggtctcaaactcatgacctcaggtgatccacccacttcagccttccaatgtgctgggattacaggtatgggccaccatgcctgggtttctccgcttattcttaatattttaactcagctgtttccctcctc

SEQ ID NO: 80485 - DNA, 601 bp, Human
aacacctcctctcataggcatgcaggtgaacagatgggtgggtgggaggttccccttcacccacagtcctgaatctgagttcttgggttaggatttggtatggcagccttcacattgcacagatatccctacattgggctgctctgcatgcctgcaatgagagtttttgggcttcttgcaggcaggaggtgctgagtattcacaccaaagcttggacatataagacaccagtgacccctattctgctaattcataacactcagccggctcccacattcccactgcctgtgcccatccccgrgaggctttcctaccttcctttttctgctttataaagcaacagtgagattccaggagcaaggccagcaaagcgaggtaggagagctcatagataatccaacaaacgtgtatggagagcccaccatggggtgctctccccatgaaacttcaattttttttttttttttagatggagtcttgctctgtcaccaggctggagtgcagtggcgcaatctcagctcactgcaacctctgcctcctgggttcaagcgattctcctgcctcagcctcccgagtagctgggactacaggtgcacgccac

SEQ ID NO: 80486 - DNA, 601 bp, Human
tcagcatgttgaccaggctggtgttgaactcctgacctcaggtaatccacctgcttcggcctcccaaagtcctgggattataggcatgaaccaccacacccagccacaaatatgacttcttaatgattaatgattaggagaccaggtatgagtttagaatgcttgaattccttggactctatatcagaaagcagaggtgccagagcactggtccactgaacccagcctccagctctatttttctgcacatctctgttttccctcaccatgactgtcttgcagatttgtgcacagacactcmagcatgtgtgtctgagttttgtctacctgctctgtggtgggggcttggatgcactgcccagatccttcttctggaaggaagggtcaggtttctgcagctactcccagctgtcagcctttcaggtttgtgggggctaaagaaaatggccttgtccaaagttgcatctggatctggtatccaatcaatgcagaggcataaaagccttgtcccttgtgctaactcggaagaagggctccttggcttcagagctccctgtgggttggctggggcatttgtcagatatgctttgcagctccgtgc

SEQ ID NO: 80487 - DNA, 601 bp, Human
aaatcagtgttaaagaggctggtcccacagctatctctgtgtccctggaagccgtgtcctttttctatttaattagtgccaagtatatggtcttgcatgaaggaggacccagattgaactcctgtagcatgatgtgtgtttcatgcactctactgttttcactgatttatggcatttaattatcaatctgttaatccaagtttttgtttaattggattcatcaaactaattgtatgaattccactctgttatcatggcctgaacctgaatatcagattcccttaataaacagaaacagtgmatgtgttcctgcttcttcctgatcaggaagggggtctgcagtcctctggtcttgtttgtttcgtagcatttcattttgtattcagcatttctttgagcgccctctttgcttcttggaaccttgccttactaccattgccattctcataggtccctgctctactggacctaaaatggtagggaagaaaggaagaggaggggagtaagaagagaggaaaaggtgagctctattctccgtcagtgtgtctgtggctgtattgattcggaagtttaaaatctaaactccctgtctacagtcttg

SEQ ID NO: 80488 - DNA, 601 bp, Human
atctctgtgtccctggaagccgtgtcctttttctatttaattagtgccaagtatatggtcttgcatgaaggaggacccagattgaactcctgtagcatgatgtgtgtttcatgcactctactgttttcactgatttatggcatttaattatcaatctgttaatccaagtttttgtttaattggattcatcaaactaattgtatgaattccactctgttatcatggcctgaacctgaatatcagattcccttaataaacagaaacagtgaatgtgttcctgcttcttcctgatcaggaaggrggtctgcagtcctctggtcttgtttgtttcgtagcatttcattttgtattcagcatttctttgagcgccctctttgcttcttggaaccttgccttactaccattgccattctcataggtccctgctctactggacctaaaatggtagggaagaaaggaagaggaggggagtaagaagagaggaaaaggtgagctctattctccgtcagtgtgtctgtggctgtattgattcggaagtttaaaatctaaactccctgtctacagtcttggcctgtcttgaaggttgtgagtcaacttagtg

SEQ ID NO: 80489 - DNA, 601 bp, Human
cttctgtgatgaaatacatgagggtttctccccaccaaaaagtaagcaatcagttctgctgcagataccagctgggtgtcctctaactcatttccgacaccagctacctggagacagcatcagatgccacaggttgagggctcagtcccacaagactgccccacttacaatgccaatggcaagcccaggttgttttgcctgggcttctgaccaaccaactagaaattgggattcccatgatcccctccttgggtttgattaatttgttagactggttcatgaaattcagaaaaacacttayatttactggtttattataaaggaggttacataggatacagaagaagagatgcatagggtgaggtatgggaaaggggcaccaagctttcatgccctccttgggcacaccatcttcaaggaacctccacatattcagctatctggaagctctctgtaccctctcctcttgggccttttgtggggacatcactggataggtgtgactgaagtatggacaaccatgtagcaatgtgattggacagaaactgtgacctaccacaaatagactgagtgggaaaaccccacagggcctgtgtgttca

SEQ ID NO: 80490 - DNA, 601 bp, Human
tgttcatccagcccaatgcacggcccaccacccacctggctgcctgggtgggcgggcaccatgggctcatgctggctcaccagcctcctttctcactcagttcccagtcttgtcagtcttgcctctttagcatctcacaagcctgcctacctttatcacactgacattgtgggcccctcttctgatcataatagcaacttttcctgctttgctgttccactgttgccctcttaccaccttctccaggtggttttgagtaagcatcttaaaataccaatctggtcattgcacaaggctgccygatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggaaagaaactaatttagaaggggacatggttaaggagtatcatccagagaaatattcgattgaatcatgtgaaattgctgatatttcaccatttttgacctagaaaaatgacaatttcatatagttaacccaata

SEQ ID NO: 80491 - DNA, 601 bp, Human
ccaatgcacggcccaccacccacctggctgcctgggtgggcgggcaccatgggctcatgctggctcaccagcctcctttctcactcagttcccagtcttgtcagtcttgcctctttagcatctcacaagcctgcctacctttatcacactgacattgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagsataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggaaagaaactaatttagaaggggacatggttaaggagtatcatccagagaaatattcgattgaatcatgtgaaattgctgatatttcaccatttttgacctagaaaaatgacaatttcatatagttaacccaatatttagggatttg

SEQ ID NO: 80492 - DNA, 601 bp, Human
gacattgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggaaagaaactaatttagaaggggacatggttaaggagtatcatccagagaaatattcgattgaatcatgtgaaattgctgatatttcaccatttttgacctagaaaaatgacaatttcatatagttaacccaatatttagggatttgaagtcatcttcagaagggtcagatgctgtggctggtctccttgcccttgacacacaggcatagtttgctcccccacccctctgcatgtgccctggtgggcctctcccagcccacccctcaccctcaccaggccttcccattcagccttca

SEQ ID NO: 80493 - DNA, 601 bp, Human
tgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggraagaaactaatttagaaggggacatggttaaggagtatcatccagagaaatattcgattgaatcatgtgaaattgctgatatttcaccatttttgacctagaaaaatgacaatttcatatagttaacccaatatttagggatttgaagtcatcttcagaagggtcagatgctgtggctggtctccttgcccttgacacacaggcatagtttgctcccccacccctctgcatgtgccctggtgggcctctcccagcccacccctcaccctcaccaggccttcccattcagccttcaaggtt

SEQ ID NO: 80494 - DNA, 601 bp, Human
ggacaagccgcagacaaaactcctcagacgctgagttaaagaaggaaaagctttattcggctaggagcttcggcaagactcacgtctccaacaactgagctccccgagtgagcaattcctgtcccttttaagggctcacaactttaagggggtctgcgtgagagggtcatgatccatgtgagcaagcagagggtacgtgactgggggctgcatgcactggtaattagaatggaacagaacaggacagggattttcacagtgcttttctatacaatgtctgaaatctatagataacataacygattaggtcaggggtcgatctttaactgccaggcccagggtgtggcaccgggctgtctgcttgtggatttcatttctgccttttagtttttacttcttctttctttggtggcagaaattgggcataagacaacatgagaggtggtctcctcccttaataagattaagtctgccttgttcaggactgtattctcagtgatttgccagtgctggatggtacaggggttcccaataaacatgtattgaatgaatgattgaataaatatgtgaattaatgcaaataatttgtaaacatcctagg

SEQ ID NO: 80495 - DNA, 601 bp, Human
ccgcagacaaaactcctcagacgctgagttaaagaaggaaaagctttattcggctaggagcttcggcaagactcacgtctccaacaactgagctccccgagtgagcaattcctgtcccttttaagggctcacaactttaagggggtctgcgtgagagggtcatgatccatgtgagcaagcagagggtacgtgactgggggctgcatgcactggtaattagaatggaacagaacaggacagggattttcacagtgcttttctatacaatgtctgaaatctatagataacataaccgattagktcaggggtcgatctttaactgccaggcccagggtgtggcaccgggctgtctgcttgtggatttcatttctgccttttagtttttacttcttctttctttggtggcagaaattgggcataagacaacatgagaggtggtctcctcccttaataagattaagtctgccttgttcaggactgtattctcagtgatttgccagtgctggatggtacaggggttcccaataaacatgtattgaatgaatgattgaataaatatgtgaattaatgcaaataatttgtaaacatcctaggctcatct

SEQ ID NO: 80496 - DNA, 601 bp, Human
ctttattaccatcctgttaggctcctttcgcatccagcataaattccacagtccttgttatgtcctcctcctctctgccccttgggctcttcatgaggtggttccaggctactggtccaacctcatctctgtaatcctcatctgcaccaggtgactgatgctccattctagcccatttccctacattaactgtgctccacagcagcacctttgcagagccctccccgacctagcccctgtgctcacactcatccttatgactcagcacaattgtccttctctataaagcctttctggcctyctgctatttcctgcatggtacccatagtggtagccatgtacacgaatgtgttgcattcactcagtctgtctaattctattagactgtgagctccttgtagatggagcctttacttttcttatattccaagtggtattctaaggtttccatgccttactttccttgtattctaagtggttgtcgtgctgtttggcatgtagtcaacagacaaattgtatttaatgcaagaatgaatggataaatcgcaattttatcttgttcctccttggaaatttatttgcaacttgattatcttgacac

SEQ ID NO: 80497 - DNA, 601 bp, Human
ttgtcttgccatcaaatcttagtggtatataatagaatagaaaaaaacgactcttaaagagcttgacccacttactctcactccttcagggttattgtttccagaggtgagtagttaagtgtgattttctcctagcttgttttctcttatggccaaaccttgctttagtttttattttctcaattattacatattatctgttatcttttttaaagggtcaaatgaaatattcagaaggctttactttatagatgggttcctgttgaaatggatcttatatctctaaccattgtacaggagraattcattattgcctgatggcaaactcatgtctctggaccaagtgggccaagccctccccctgaggatgggtgtagtggttccatttaactgatggaatctcttgtatgcatgactaatgtgaacatttctcttctttctagaatctcttcattctaactctactttttttcctgaagttcaacataaaacctttaccacgaactcttgagcacttggtagattataagtgatgcttgcgtccttgtcctctagtgaacctttaccacaaactctcgagcacttagtggattatagctga

SEQ ID NO: 80498 - DNA, 601 bp, Human
ctgtgacagaagatttagagccttcagtggttcctacagtcaagtggcagggatcctagagcacactgctgctctcagaatggatctggcttgttctggagtttttgagattgacagagctcaaagttcccaggctccagagctcaggtgctggggaggatttcccatcacttctgagatttggggagctccaaggcccctcctcttgaccctcagtggagctcaaaagaaaatcgtcttgacctcagagacagcattttggggtgaagatactccaatatacttgtttctttctttcttctttttttttttttattatactttaagttctagggtacgtgtgcacaacttgcaggtttgttacatatgtataccagtgccatgttggtgtgctgcacccattaactcgtcatttacattaggtatatctcctaatgctatccctcccctctccccccaccccatgacaggccccggtgtgtgatgttccccttcctgtgtccaagtgttctcattgttcaattcccacccatgagtgagaacataccatgtttggtttttcgtctttgcgatagtttgctgagaatgatggtttccagct

SEQ ID NO: 80499 - DNA, 601 bp, Human
tctgtcacccaggtgggagtgcagtggcacgatcacagctcactgcagcctcaacctcctgggctcgattaattatcttaccttagcctccaagtctaggtccacaagcacacaccaccatgtctggctaattttaaaattttttgtagagatggggtcttgcaatgttgttgagactggccttgaactcctgagctaaagtgatccttctgcctaggcctcccaaagtgttgggattacaggtatgagccactgtgcctggcctgaggctgtttaaaagaacaaaaatctttataaaaartttcattgctgtttcttttctaaaataagttgtctataccagtggcatgcaaaatgtatcatatcagatttaatatgtgaataatgagggaaactgtgactttggacagaagactgtcgtagactgctctagtagaacagaatcttagctaatcaccatgcagatcccctgggttttagagttcatactgatcctcaactgggggctaacaatggtttctcatttatcattttcccctgcttgttcagcattctacttgaagccacagagaatgatggagcttacatatttcctttgata

SEQ ID NO: 80500 - DNA, 601 bp, Human
atttagaaattttagttacttttaaagtaaagtacaagtttaccaggaagtacaaattaaaataaaacgtggagaatacaacacctttcaaaggaaagtagagaaattggatgattgaggtaattagaaaataatattttgagtatagtttgatggatttcaggcttcttcagcttgacaaaaacagaaaagagggggaaagttcaaaaatattattatggatttgaagagatgtcactcagaagatcttgataaaatgttcctcatccctagtggatggggggcgtgggtggcagggtayaaaacgaaacatggaaccagtgatgggcttttaggaaattctatatggagcttttaccatgcaccagacctcaggctggggaccaggggtacaaggatgagtaaggcatctggccttcccttaaggagcttgttgtctcatggctgggacatgataaggacattactacagacatacatgaagagctaaaggaataatatatggaggaagaactagttctgcccaagggggaagtcaagggaaggtaccaagaaagtatagcatttgagttggatgaagaactggccaagacagctgagg

SEQ ID NO: 80501 - DNA, 601 bp, Human
gaagagatgtcactcagaagatcttgataaaatgttcctcatccctagtggatggggggcgtgggtggcagggtacaaaacgaaacatggaaccagtgatgggcttttaggaaattctatatggagcttttaccatgcaccagacctcaggctggggaccaggggtacaaggatgagtaaggcatctggccttcccttaaggagcttgttgtctcatggctgggacatgataaggacattactacagacatacatgaagagctaaaggaataatatatggaggaagaactagttctgcccragggggaagtcaagggaaggtaccaagaaagtatagcatttgagttggatgaagaactggccaagacagctgaggaaagggagatgtagattaggggccgacacaagtaaggggttggcaaggacatgaactgaacggggtttgaggaaaaagcttagcacggggtcaagaacgtagattttggggttagagtacctaattctggcctcctcaatattttctagtttcatgatcttggtcaaattatttaatctctctaaatttcaatttctctgtctatacaagaaaataaagtaggcc

SEQ ID NO: 80502 - DNA, 601 bp, Human
ggaccaggggtacaaggatgagtaaggcatctggccttcccttaaggagcttgttgtctcatggctgggacatgataaggacattactacagacatacatgaagagctaaaggaataatatatggaggaagaactagttctgcccaagggggaagtcaagggaaggtaccaagaaagtatagcatttgagttggatgaagaactggccaagacagctgaggaaagggagatgtagattaggggccgacacaagtaaggggttggcaaggacatgaactgaacggggtttgaggaaaaagcwtagcacggggtcaagaacgtagattttggggttagagtacctaattctggcctcctcaatattttctagtttcatgatcttggtcaaattatttaatctctctaaatttcaatttctctgtctatacaagaaaataaagtaggccggccatggtggctcacgcttgtaatcccagcactttgggaggccaaggtgggtgggtcacctgaggtcagaagttcgagaccagcctggccaacatggtgaaaccccatctctactaaaaatacaaaaaaaatattagccaggcatggtggtgca

SEQ ID NO: 80503 - DNA, 601 bp, Human
ggtgggtgggtcacctgaggtcagaagttcgagaccagcctggccaacatggtgaaaccccatctctactaaaaatacaaaaaaaatattagccaggcatggtggtgcatgcctgtaatcccagctacttgggaggctgaggtaggagaattgcttgaacctggaaggcggaggttgtagtgagctgagattgtgccattgcactccaacctgggcaacaagagtgaaactccatccccccacccaccaaaaaaaaaaaaaaaaaaagaaagaaaataaagtagtacccccttcagtgtgytattatgcagactgaatggtatgaaaagcatgttttcaccattactggcacatgctcagttaacgttttcctgccattcgtagcagcaggatgaggagtattgaaaaggctaaagattagagttctgggaagaataataaggattagatgtcagaaagtgtgtcatgacatatttgtgtgtatgcgtgtgggtacacagaattttgaaatagttttcaattgaagcctttgtttgtaaccagtagcacagggagatgttcagttttgcacataataatgaatatctgttatgtctgttag

SEQ ID NO: 80504 - DNA, 601 bp, Human
attagccaggcatggtggtgcatgcctgtaatcccagctacttgggaggctgaggtaggagaattgcttgaacctggaaggcggaggttgtagtgagctgagattgtgccattgcactccaacctgggcaacaagagtgaaactccatccccccacccaccaaaaaaaaaaaaaaaaaaagaaagaaaataaagtagtacccccttcagtgtgttattatgcagactgaatggtatgaaaagcatgttttcaccattactggcacatgctcagttaacgttttcctgccattcgtagcagyaggatgaggagtattgaaaaggctaaagattagagttctgggaagaataataaggattagatgtcagaaagtgtgtcatgacatatttgtgtgtatgcgtgtgggtacacagaattttgaaatagttttcaattgaagcctttgtttgtaaccagtagcacagggagatgttcagttttgcacataataatgaatatctgttatgtctgttagccatttgtaactactattgttgtttctgtcatctccagtaaagtgtttctgtattttcacaaaaatgagcaagacctaccacaaaaa

SEQ ID NO: 80505 - DNA, 601 bp, Human
agaataggagattgtgtttcccaggtagaaaaggagactttgaaatctttctcataaaatgcgtgaaaatctggtgccatcagatcatgagtcttgtcatcaggatgggactcactcttggatccatcaaccagctagctaggtaactctgagcaaataccagatgctcttcagcctgtgtcctgatctgtaaagttgagatcataatagtaatacttcacagtgaaattgtacactagaatgaaagaatgcataaaaagtgcctcgtaccctgccacgcacagagagggtgatacacatyggtcccctcatccagcatcttctaattcacccctccctgtccccagcttctcctgtctggggatctcaagttgggaatggtcatctttggatgaagctgccatgtttatgtggacttagaggcagatattctattgggaattcaatggatgcataaggcagtgtaggggaactgatttttagggagcaatatgaagtcagagaaattgcactcttatctctacttacgttcctcatggtcccttttattcttttatgacaaatgttacttcaagctacagtagtgttttcaccaggggct

SEQ ID NO: 80506 - DNA, 601 bp, Human
ctctggggtgtcccatgtcagcctcagcagtccctttcatccatgtggctctcattaaccagtccttgctatcattttccttgcctggctactctggtcttttgctttctccttccccagtttagggactggtgggtacaaacattttagaatgaccatgaagtaatatcagttagctgaaacatatctatcaagattctttcctacccaggtcaggctcataaacagatgagatggagaaaataggtcttcctgctgtttcagctgacggtccacccatgctgcaggtcctgctggaagytcacttctgtgttctggtctgtgctttgatttcttctaatctttggtgatggcataaggataacgcaatgcaggctaaagaaaaccctttaagaaatctgttcacttactggcggatttgcttatcataggcatgccctgaccttgaagagtccttgctctggtagggaagcgcatgtacatggatgattaaaataaatgcttcatgtcaaaatacaggtacagaatgctattttgctacgaaggaaagaataactagcttttccaagaggagtgagggagagcatcaaagagagctggc

SEQ ID NO: 80507 - DNA, 601 bp, Human
ccagtccttgctatcattttccttgcctggctactctggtcttttgctttctccttccccagtttagggactggtgggtacaaacattttagaatgaccatgaagtaatatcagttagctgaaacatatctatcaagattctttcctacccaggtcaggctcataaacagatgagatggagaaaataggtcttcctgctgtttcagctgacggtccacccatgctgcaggtcctgctggaagctcacttctgtgttctggtctgtgctttgatttcttctaatctttggtgatggcataargataacgcaatgcaggctaaagaaaaccctttaagaaatctgttcacttactggcggatttgcttatcataggcatgccctgaccttgaagagtccttgctctggtagggaagcgcatgtacatggatgattaaaataaatgcttcatgtcaaaatacaggtacagaatgctattttgctacgaaggaaagaataactagcttttccaagaggagtgagggagagcatcaaagagagctggcttttaagggataaagcagacattgcctgagataagagctatagaattgcttattgtga

SEQ ID NO: 80508 - DNA, 601 bp, Human
agcttttccaagaggagtgagggagagcatcaaagagagctggcttttaagggataaagcagacattgcctgagataagagctatagaattgcttattgtgagaaactacagagttgggaagatcgagatgagacaggcatatgagcagaagtgagagacctggcaggaataagagctagcacttagaccctgcttgctgtagggcgtgcacaggtctaagtgctttatatcaagtacctgtgcagttctctccacagtccaacaatccttccattatggatgaggaaacacatgcgcacygagttcagtatcttacctaacgctgtgcgactgcaagcggtggagctgggctttgaacctatgcagtctggcttctacactacacttccaggcagagggcatctccctgtgcttctgggataaaacttgcagcactgccttgtctaggactcaagaggcactgttttctcctcccctactggttctgcagtctttccaactctttccacttcatcaatgagccatgtccatcctcacatcactatgtgtctgtgtaatacttagggccactgagttatggggaaaaagagaaatggatat

SEQ ID NO: 80509 - DNA, 601 bp, Human
aatccttccattatggatgaggaaacacatgcgcaccgagttcagtatcttacctaacgctgtgcgactgcaagcggtggagctgggctttgaacctatgcagtctggcttctacactacacttccaggcagagggcatctccctgtgcttctgggataaaacttgcagcactgccttgtctaggactcaagaggcactgttttctcctcccctactggttctgcagtctttccaactctttccacttcatcaatgagccatgtccatcctcacatcactatgtgtctgtgtaatacttarggccactgagttatggggaaaaagagaaatggatatttcttagtattgtctggtggttctgttatctcacagttcatggaaaccagatcactacaggcacaaggcattaccatcagtctcagagaaggcctgacaccctgttatagatcagagagtcctggccaccactaaaggtcttggaaagacacggggaaggcaagcagaagcacaggtggcctgaagacatctccttccggccaagagtccccctgctcatcccccaccccacccaggcaccaccctccacagctaaaggtgttt

SEQ ID NO: 80510 - DNA, 601 bp, Human
agccatgtccatcctcacatcactatgtgtctgtgtaatacttagggccactgagttatggggaaaaagagaaatggatatttcttagtattgtctggtggttctgttatctcacagttcatggaaaccagatcactacaggcacaaggcattaccatcagtctcagagaaggcctgacaccctgttatagatcagagagtcctggccaccactaaaggtcttggaaagacacggggaaggcaagcagaagcacaggtggcctgaagacatctccttccggccaagagtccccctgctcaycccccaccccacccaggcaccaccctccacagctaaaggtgtttatgctgtaggaaccctgtggtggtaggagatcgggggtgatagggctgcttggataggaaacatatgtgattgttggcactgctcttcatactgttgtcaaattcctcactgcttctgtgtacttggggtgacagtctgacagcctgtgaggtcagacaaagcccagattacttccctctcgcctttccgtctcgcacttgtgggctgccattcttaaaggagtcacgtgtgggctttctttgccagaagtaggca

SEQ ID NO: 80511 - DNA, 601 bp, Human
gacagtctgacagcctgtgaggtcagacaaagcccagattacttccctctcgcctttccgtctcgcacttgtgggctgccattcttaaaggagtcacgtgtgggctttctttgccagaagtaggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctraactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaac

SEQ ID NO: 80512 - DNA, 601 bp, Human
ctttccgtctcgcacttgtgggctgccattcttaaaggagtcacgtgtgggctttctttgccagaagtaggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctgaactgcagttactgtgtttggaggtaacatcatccccttctttggtttgtggrtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaactctttgacctacacatttgtcagataaaatattttgggtgagagcttgttagc

SEQ ID NO: 80513 - DNA, 601 bp, Human
taggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctgaactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaactctttgacctacacatttgtcagataaaatattttgggtgagagcttgttagcagatctatttccattccactcttggcatttattagcgagccctcttcgggaagccgtatgttctgag

SEQ ID NO: 80514 - DNA, 601 bp, Human
gtcatagacgtctcctgaactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacatarttattgtctctctaactctttgacctacacatttgtcagataaaatattttgggtgagagcttgttagcagatctatttccattccactcttggcatttattagcgagccctcttcgggaagccgtatgttctgagaagtaggaagaataacgcattttacctatagtgcaatgtctggccagcgcctattctttctgggttgagctgctggaatgtattcaggggataagctgagaggcgatttacgaggagtgctctctccttgtcttgctcctgcttccctttaaaattccttggct

SEQ ID NO: 80515 - DNA, 601 bp, Human
acatttctatgttttctttctccaacagccagatatatgtgtccacttagctgcacataattattgtctctctaactctttgacctacacatttgtcagataaaatattttgggtgagagcttgttagcagatctatttccattccactcttggcatttattagcgagccctcttcgggaagccgtatgttctgagaagtaggaagaataacgcattttacctatagtgcaatgtctggccagcgcctattctttctgggttgagctgctggaatgtattcaggggataagctgagaggcratttacgaggagtgctctctccttgtcttgctcctgcttccctttaaaattccttggctgcccttagtgtggcatgtgtttccatttatcctatagttctcaagactcaatggagctcttgtacttctgaagggcacttactaggaagcccttctccctgacgttgagcttgcactgatcaaaacggggggccccacaaaccatcacagggatatctatgcaaagggggaatgtttagcaccaaagttaaggactgtgcatgctttggcagaattacaaaaggaaaaataagtggacaaa

SEQ ID NO: 80516 - DNA, 601 bp, Human
gtgcaatgtctggccagcgcctattctttctgggttgagctgctggaatgtattcaggggataagctgagaggcgatttacgaggagtgctctctccttgtcttgctcctgcttccctttaaaattccttggctgcccttagtgtggcatgtgtttccatttatcctatagttctcaagactcaatggagctcttgtacttctgaagggcacttactaggaagcccttctccctgacgttgagcttgcactgatcaaaacggggggccccacaaaccatcacagggatatctatgcaaagrgggaatgtttagcaccaaagttaaggactgtgcatgctttggcagaattacaaaaggaaaaataagtggacaaagtatgttactttttttttattattatagggtgtgtgtggtttatttgaacatcaacaaaaacacaacagaaaggggtaaaatgtaaaggaaaagcccctttgctgtcctccaaccctgaggaagctgttagcagttttaagtgcatccttccagaaatatctccctcatgtatggacatatatgtcctttagttagttttagaaaattcaaatggaatcataacag

SEQ ID NO: 80517 - DNA, 601 bp, Human
gtggtttatttgaacatcaacaaaaacacaacagaaaggggtaaaatgtaaaggaaaagcccctttgctgtcctccaaccctgaggaagctgttagcagttttaagtgcatccttccagaaatatctccctcatgtatggacatatatgtcctttagttagttttagaaaattcaaatggaatcataacagaattttgttctgtgccttgccgtttttgcttaatttttcttggaggtctttcaactttaagaggtaaaaatggctgtatgatatgtaacaataagtgtggctgattccarttttctccatttggttgtttccagttatttctcatgctgcaatgatcatccttttttatatgtctcttttaccttgtctgaatattcctgtagagtaaatgcctagaagaggaatagctagtgaaaaggacatgtgcattttaaattttgaccaatattgctgaattactttcctaaaaaaggcagctgacgtatccctcacctttaaaacagcaaactatacaactctcagacctttgtctccgaatctgtgcatctttatattggatgcaaatcacgtgttgattggctggttttttt

SEQ ID NO: 80518 - DNA, 601 bp, Human
cctcacctttaaaacagcaaactatacaactctcagacctttgtctccgaatctgtgcatctttatattggatgcaaatcacgtgttgattggctggttttttttcttcctctgccttttttgcttattttcttttgggatatttgcttttttacttcttgactttcaaaactctttgctggttaataaatctaactcatagaccatgcaacgtgttagaaatatttttttctaatatgtcatttgtattttgactttcatttatggcacgtttgccacataagagtttaaattgatatgkgtctaaatttttcactgtttttcacttttggatttcaggtttgtgtttgcttagaaagtttttccccacttcgagtcagtcaaataatgtaaaaattttcatttagctattgggcagcttagaagccaatactagactggccaaatagagtggcatgttgagacttaccctgagattttagtttttaatgcagcgaatccattgggatcacttataaaaaaggattttaccctattaatctttactagaatggatatttttaaacttaatttttttgtgcttctcattgtaggagtcctt

SEQ ID NO: 80519 - DNA, 601 bp, Human
tgagggcatcttgggaaaggcctctgagaattttactctccatttgaaaaggaataagaggcattcacgtttttggagcaatactagatgggatagattggaagtatgaaatatttgaaggcagaaaggcccatcactaattgtagttttcctggagtaaagaaataaaatgcttaatgtggagtagtactggaaatggggaaaagcagacctgaacaatattctcagtttataatctgtaagagggtactggggctgaggaaaataacaagtttaaaaatgaccaagatttctagccttyatttggttcactctcttaacatgcattgagttcttgctttatgtcagcactgctctgggcgcttggactagaggagttgaggagttggcacgagacaggatccctgctctcaaggggccacagaaaacaaacaggccaggatgatggcaggtataaggaaaccatgaaaaaaaatggagaaattaagaagaagggcttgtttgatggggagccctgataactttgattctgtgtcttaaaacttcaattcatgcttcatataattatcaatttaattattgctggtggtgttctctttct

SEQ ID NO: 80520 - DNA, 601 bp, Human
ttagccctttgtcagatgagtaggttgcgaaaattttctcccattttgtaggttgcctgttcactctgatggtagcttcttttgctgtgcagaagctctttagtttaattagatcccatttgtcaattttgtcttttgttgccattgcttttggtgttttggacatgaagtccttgcccatgcctgtgtcctgaatggtaatgcctaggttctcttctagggtttttttggttttaaggacctggttattttcaaagcttccaagaaatggagtaaaatactaatgccctttaagtgaacrtattaataaatcaggaaagagagtttggttataagagctgaaactctaggcatctgtgtcagaactcagtatttactctcctaaaatggatagaaacctacaaactcactgcctaccctctcccagagcaccattccccatagaaaaccccatagaaaaacactaacatgcctgggtctcaggaggattcaagccacactcagatgatctcctagaccccattttacttccaactggcaggaatcacaggaatggtgaatatcaattctgttctcaagaacttacccccaaacactgaaa

SEQ ID NO: 80521 - DNA, 601 bp, Human
caccctcctaccacctgaacccactgggacctgcacaagtgagggccttggcagtatccacttctccaaagacccaagaccagcctaagtagtaaatatgcctaaggaaataagaactcatttggaaaataaacaagactgctttggaggacaactgttaaaaaagaacggtaataaatggaatggctaaaacctgatgaagcatggttattgaagtagacatacaaggtgttcaacacacatatcaaatattccccaaagataaggaaggatgttggaaacatgacataaaacatgaagycctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacatcagcaatagtcagagagagggaaaacttaaaagataaatgaagcaatatgaagaatagcaatatgaagatcaacattcatataaaaagaatcccagaaggaaggaaaacaatcaatagaaaaatggaaggaaacatatgagagaaagattgagaaccgcc

SEQ ID NO: 80522 - DNA, 601 bp, Human
gctttggaggacaactgttaaaaaagaacggtaataaatggaatggctaaaacctgatgaagcatggttattgaagtagacatacaaggtgttcaacacacatatcaaatattccccaaagataaggaaggatgttggaaacatgacataaaacatgaagccctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacaycagcaatagtcagagagagggaaaacttaaaagataaatgaagcaatatgaagaatagcaatatgaagatcaacattcatataaaaagaatcccagaaggaaggaaaacaatcaatagaaaaatggaaggaaacatatgagagaaagattgagaaccgcccagaaaaaggaaaaggtataaaacttccgaccaatgggcttagtagagtgcaaaacaggatagaaaaaaaggtgatgggcatacctcaataggttgtaataacatttatgtaaaacaatgatagagagaacattctaaga

SEQ ID NO: 80523 - DNA, 601 bp, Human
tggctaaaacctgatgaagcatggttattgaagtagacatacaaggtgttcaacacacatatcaaatattccccaaagataaggaaggatgttggaaacatgacataaaacatgaagccctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacatcagcaatagtcagagagagggaaaacttaaaagataaatgaarcaatatgaagaatagcaatatgaagatcaacattcatataaaaagaatcccagaaggaaggaaaacaatcaatagaaaaatggaaggaaacatatgagagaaagattgagaaccgcccagaaaaaggaaaaggtataaaacttccgaccaatgggcttagtagagtgcaaaacaggatagaaaaaaaggtgatgggcatacctcaataggttgtaataacatttatgtaaaacaatgatagagagaacattctaagagcaggtcaattattaaaggatgagaactagatcgacctcagac

SEQ ID NO: 80524 - DNA, 601 bp, Human
tgtagaaattgaaaagctcagcaaatttatatggaaaaacataaatatgatcttacagatacaaaggaaactaccagaagacaaaaatataatgtataatttttagaccaatagaagaagatttgatccacccaatggaaagtaggaaaagagaaaaaaaataaaatgtttaaaaagtaagggaggattcctggtctgggaaaaaaggcatggaccatttctctctgcttcttcccactaaatgcaattctaaatcctgaaaataatgcaagagctaatcaaatgagaactctgaaagacygtgagaggacagaaatctgccttgggactgcaggactagagagaaaacatagcttcagggcttcctacatacctacttcatgaaaaaagatgacctagacctggatttcctgacctccaaccaagcaaccaaaggcagctcagctaggtttattcctgccctggatttggagccctgctaacaataagcagccaggggagagctctccttccctcctggcctccaactcccttcccctcccagagacacctggttagccaggagcccctggcaagagggaccctgccacaacagatgccc

SEQ ID NO: 80525 - DNA, 601 bp, Human
taagggaggattcctggtctgggaaaaaaggcatggaccatttctctctgcttcttcccactaaatgcaattctaaatcctgaaaataatgcaagagctaatcaaatgagaactctgaaagaccgtgagaggacagaaatctgccttgggactgcaggactagagagaaaacatagcttcagggcttcctacatacctacttcatgaaaaaagatgacctagacctggatttcctgacctccaaccaagcaaccaaaggcagctcagctaggtttattcctgccctggatttggagccctrctaacaataagcagccaggggagagctctccttccctcctggcctccaactcccttcccctcccagagacacctggttagccaggagcccctggcaagagggaccctgccacaacagatgcccagcctgggaagtgttctcctctcccctccctgccccaccaggggcaaggggaattctgccacagtaggtacccagccagggaagtcttcttgtcctccagagtctgagactttacacccgcaccaagagacattcagttacctgacctggggggaggccccttctgccttctgcccc

SEQ ID NO: 80526 - DNA, 601 bp, Human
ataaaactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcag

SEQ ID NO: 80527 - DNA, 601 bp, Human
aaaactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtg

SEQ ID NO: 80528 - DNA, 601 bp, Human
aactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtgga

SEQ ID NO: 80529 - DNA, 601 bp, Human
gtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaat

SEQ ID NO: 80530 - DNA, 601 bp, Human
cccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatccctkaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggca

SEQ ID NO: 80531 - DNA, 601 bp, Human
aaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacrtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttacca

SEQ ID NO: 80532 - DNA, 601 bp, Human
taggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatggracgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaag

SEQ ID NO: 80533 - DNA, 601 bp, Human
aattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacayaagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtac

SEQ ID NO: 80534 - DNA, 601 bp, Human
ctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcayataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccag

SEQ ID NO: 80535 - DNA, 601 bp, Human
tggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactmtttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaat

SEQ ID NO: 80536 - DNA, 601 bp, Human
ggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagmaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagacaatttaggctttaaggctaaaatatcatcaacaat

SEQ ID NO: 80537 - DNA, 601 bp, Human
tttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttrtgttggagtcattttaaaaatatgcaaataaactgaaaacatagaatggtaaaaagataagctgggtaaatttgaattaaaagagtgttggaataacaattttagtatcagacaatttaggctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaaca

SEQ ID NO: 80538 - DNA, 601 bp, Human
tgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagrcaatttaggctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctt

SEQ ID NO: 80539 - DNA, 601 bp, Human
atttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagacaatttagrctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctttttggacat

SEQ ID NO: 80540 - DNA, 601 bp, Human
ctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctttttggacatrtatggaaaatttacaaaaatcaatgaagtactaggtgataggagaaccctcagataattttatagagttaattctcaaccagtatgcaataaaattagatattaatctaacaaaaagggaggtgaaaaaaatttattctatttagaaacgaaaaaacatatcactatacagcccttgaattaacaagggaaccattaggaaagataatgaaaaggctgtctgtcaaatctgctggacaacaatgctgtaaattctaaaaatatatataatgcaattacagaaaaatatttcaaattgata

SEQ ID NO: 80541 - DNA, 601 bp, Human
tcagcattttaaagatgttttattgtctcctagctttcaccacttctgtcatccatatttttgttcctttgaagttaatgtgcctttcttttctctcactgcttttaagagttttgttctgtctttgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttccsatctcatcatttatggacatgggctttgagagaatgttaattaatatgtccaagaaaatagggaacatgatggagaattttgacagagaactggaatatataaaagaaaatcaaattaaaagtaactgaaacttagaacacaatagtggattgaacagcagattcgagacagtagaaggaagggttattaaatggaagataggtctgtagaaaatatctagcatgaagctgtctggatgggagaaaatatatattttcattgaaaattcctgatttttggttttccaaaaaaaagtcaaa

SEQ ID NO: 80542 - DNA, 601 bp, Human
atatttttgttcctttgaagttaatgtgcctttcttttctctcactgcttttaagagttttgttctgtctttgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttcccatctcatcatttatggacatgggctttgagagaatgttaattaatatgtccaaraaaatagggaacatgatggagaattttgacagagaactggaatatataaaagaaaatcaaattaaaagtaactgaaacttagaacacaatagtggattgaacagcagattcgagacagtagaaggaagggttattaaatggaagataggtctgtagaaaatatctagcatgaagctgtctggatgggagaaaatatatattttcattgaaaattcctgatttttggttttccaaaaaaaagtcaaaattttgtcaacattgaatttacattcctcatagtttcagtgtgcctgagctgat

SEQ ID NO: 80543 - DNA, 601 bp, Human
tgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttcccatctcatcatttatggacatgggctttgagagaatgttaattaatatgtccaagaaaatagggaacatgatggagaattttgacagagaactggaatatataaaagaaaatcaaattaaaagtawctgaaacttagaacacaatagtggattgaacagcagattcgagacagtagaaggaagggttattaaatggaagataggtctgtagaaaatatctagcatgaagctgtctggatgggagaaaatatatattttcattgaaaattcctgatttttggttttccaaaaaaaagtcaaaattttgtcaacattgaatttacattcctcatagtttcagtgtgcctgagctgatgagttgttgatgtgctccatatacagggatatgtactcccaactagccacagtcactcctttctattatct

SEQ ID NO: 80544 - DNA, 601 bp, Human
gatggagatgaggaacttgttgggaactggagcaaaggggactcttgttatgttttagcaaagagatgggcagcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacartagaaaagaaaattccattttctgaggagaaattcaagctggctgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaa

SEQ ID NO: 80545 - DNA, 601 bp, Human
cttgttatgttttagcaaagagatgggcagcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggytgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgag

SEQ ID NO: 80546 - DNA, 601 bp, Human
gcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaycaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttggg

SEQ ID NO: 80547 - DNA, 601 bp, Human
cttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaccaaatgttaatccccaagacaatggagaaaatgtctctmgggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcct

SEQ ID NO: 80548 - DNA, 601 bp, Human
atctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaccaaatgttaatccccaagacaatggagaaaatgtctctagggcatgtcagaggtcttcatkgcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcctggatttccaggcagaagtttgc

SEQ ID NO: 80549 - DNA, 601 bp, Human
acagtagaaaagaaaattccattttctgaggagaaattcaagctggctgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtscaagccccaagccttggaggcttacatgtggtgttggacctgtgagtgcacagaagtcaagaattgaggtttgggaacctctgcctagatttcagaggatgtatggaaacgcctggatttccaggcagaagtttgctgcaggggtggagcactcatggagaacctctgctagagcagtgtggaagggaaatgtggggtcagagcccccacactgagtccccactggggcactgcctagtggagctgtgagaagagggccaccaaccttcagaccccagaatggtagatccactgatagct

SEQ ID NO: 80550 - DNA, 601 bp, Human
tttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcctggatttccaggcagaagtttgctgcaggggtggagcactcatggagaacctctgctagagcagtgtggaagggaaatgtggggtcagagcccccacacwgagtccccactggggcactgcctagtggagctgtgagaagagggccaccaaccttcagaccccagaatggtagatccactgatagcttgcaccatgcacctggaaaagctgcagacactcaatgctagcccgtgaaagcagccaggagggggactgtaccctgcaaagccataggggtggagctgtccaagaccataggaacccatctcttgcatcagcatgacctggttctgagacatggagtcaaaggagatcatttcagatctttaagatttgactgcccagctggaatttggagtt

SEQ ID NO: 80551 - DNA, 601 bp, Human
ggacttggaattttgggctaatgctggaatggattaaaactttggggtactgttggaaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttcccyctgcgttctgcacttctccttcctgccaccatgtgaagaaggtgccttgcttccctttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagccctgccctcagggaaaagaaaacaataatcacataaataattagaattgtcataaatactctgaa

SEQ ID NO: 80552 - DNA, 601 bp, Human
aaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttccctctgcgttctgcacttctccttcctgccaccatgtgaagaaggtgccttgcttcccyttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagccctgccctcagggaaaagaaaacaataatcacataaataattagaattgtcataaatactctgaaataaaagtaaaaaatgctaagagatccatcatattttccagttggaaggcagggaa

SEQ ID NO: 80553 - DNA, 601 bp, Human
cagtgctgttcccaggatagtgagttctcatgagatctggtggctttataaagggctctttccctctgcgttctgcacttctccttcctgccaccatgtgaagaaggtgccttgcttccctttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagcyctgccctcagggaaaagaaaacaataatcacataaataattagaattgtcataaatactctgaaataaaagtaaaaaatgctaagagatccatcatattttccagttggaaggcagggaatgtttctcccaaaaaggttatttaagccgagttctgaagataatatgatttagtcagatgaaggcctggttatatgtgtgttgatggagaatggacagagagagttgatctagcctggaagagttggacaggtctgaggattcaaagcaagtcagtagggctggtaacacatatatgagc

SEQ ID NO: 80554 - DNA, 601 bp, Human; identical to SEQ ID NO: 38706

SEQ ID NO: 80555 - DNA, 601 bp, Human
tgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggarggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatatattgt

SEQ ID NO: 80556 - DNA, 601 bp, Human
tggccttcagagagcagacatttgtgttcttagtcactgcctctggactgcttagaaaatcgatccttgatcctatatttggattccatggtcttataagaaagcaaccactgtcactctgcatccttgctggcccagtcacaggctctacgttaatttatagacatctgaactcgtttgttaacccaggtgctacaggtggaatcctccagcaaagcctggtctccaatgctctgggtagaggtgttgaaaagttaccacctgctgcaagtggatggcttgaaagaatattctggggtgragggaagtgccacctaagcaagggtttattcctgggtggaagaaactgcaggctctgggaatgagtctttgaaggtgtgtctggctttccaaagtgagctaccaggaggagctcggtgtggggcagtcagaagccatgccaggtatgtgatggagtccctgggtcattgattctgctggaggccaggactgattcagcagagatccctttctcctgtagcggagaaaaatgaatatctttcctttacccatctaaaggttctcagctgaggcacctatacagacagagtaacaagagaaa

SEQ ID NO: 80557 - DNA, 601 bp, Human
agaaactgcaggctctgggaatgagtctttgaaggtgtgtctggctttccaaagtgagctaccaggaggagctcggtgtggggcagtcagaagccatgccaggtatgtgatggagtccctgggtcattgattctgctggaggccaggactgattcagcagagatccctttctcctgtagcggagaaaaatgaatatctttcctttacccatctaaaggttctcagctgaggcacctatacagacagagtaacaagagaaaaatgtacaaatgtgcttaatataaaatttacatgacacagragcctgcaaaaatgaagacccaaagcaacagaaaccagtgtatttttatgcttaagtttgaagaatagcagacagatgtggagaagtataattggacaaaaggagtatgatttaatggcaataaactggggggagcttagcaaggcctgtttgctcggattcttcgctgcatccctgtgtcttcagagataaggatactcctttcctttgggtataggttgtacactttaaagatgagggtgttataatctactttagaggaaggtcagataattatttatggcctgcttcaggaaagaa

SEQ ID NO: 80558 - DNA, 601 bp, Human
ggacagactttcccaggcataggaggattcgttttcctgcatagcattataagcacctgtcaatttcactatctggctataagaacacagagctatatttgttgaaaaataggaagcttggggtcaaggatgaaaaaagagtggagccttatcctaggtcctgtggtggctgctgtttgggtgctccaggggtcccccagaaagcctcccagatcctctccaccaattgaaatgctgaggatgtcctacatttatttgttgctttcttgggggtgagtgggtgctttagaggggaccttayagcttttgctggctttcagtatcatttccctgttcctgtatcgcagtgctggatttattttcacagagagggcagccgttctctgaattcatgagtgccatggattttaagacaatgttttctgagaacggcaaaattatggggccagaaaacagataaattgttgccaggaaaggggaagggactcattacaagagcaacaggaaggaatttggtgcgtggatgttgggggcggatgatagaagtattctctctcttgattgtggtggtagttacgtgactgtgtgtatgtctaaatcc

SEQ ID NO: 80559 - DNA, 601 bp, Human
atggattttaagacaatgttttctgagaacggcaaaattatggggccagaaaacagataaattgttgccaggaaaggggaagggactcattacaagagcaacaggaaggaatttggtgcgtggatgttgggggcggatgatagaagtattctctctcttgattgtggtggtagttacgtgactgtgtgtatgtctaaatccataattttacatcagaaagagtgaattttactgtgtatgactttataacaattattttaaaaagtttttttaaatgtctacctatttaaaaaccgggctrtagatgtttgagtcagtgcttttgtctcaggactatcaaaacgcagtgtggcctgctggaaagagcacaaggcttgagtctgagtctgccgtgatcctcagttaggcctcttacaggccgcatctccacatctgttaagaaaaacaccaccacgacataagaggataatgaaaactatctcatgaagctgtgatgaagatttaaataaaaggatgcatcacgaagtgagagacgcatacctagtagaggctaatttgtgttaacttttgtttctatcactctttctggcagtcacaagca

SEQ ID NO: 80560 - DNA, 601 bp, Human
caaaattatggggccagaaaacagataaattgttgccaggaaaggggaagggactcattacaagagcaacaggaaggaatttggtgcgtggatgttgggggcggatgatagaagtattctctctcttgattgtggtggtagttacgtgactgtgtgtatgtctaaatccataattttacatcagaaagagtgaattttactgtgtatgactttataacaattattttaaaaagtttttttaaatgtctacctatttaaaaaccgggctgtagatgtttgagtcagtgcttttgtctcaggrctatcaaaacgcagtgtggcctgctggaaagagcacaaggcttgagtctgagtctgccgtgatcctcagttaggcctcttacaggccgcatctccacatctgttaagaaaaacaccaccacgacataagaggataatgaaaactatctcatgaagctgtgatgaagatttaaataaaaggatgcatcacgaagtgagagacgcatacctagtagaggctaatttgtgttaacttttgtttctatcactctttctggcagtcacaagcatctctaaaatgctttttgcatgcataatgcta

SEQ ID NO: 80561 - DNA, 601 bp, Human
tttgtttctatcactctttctggcagtcacaagcatctctaaaatgctttttgcatgcataatgctagcaacactatttgtttgtatgactcagtctccaggcttaactttcccttttgcataaggagtttggggatgcttgagattgttacattttcctttacatgtataatatactcactttttgtcaagaagtagacatgagcaatgagttagtggaagatacccagtcagagaaaggtttaacgaaggaaaactcccgtttgtattcgggtccaggattttagactacagaaggtayggggaaatgataacaagggcctcattaggaaggtgcttttgttttcctgcctgtgttttccgggagccattgaagtctgggtactttgcatttatcctgtggctaaaatgtctattcgctttgcagctctgggttggttttgctttagaactccgtgctgggtctgaccatcctatactggtttctctactgaagcttgatgccctgaaggcagtcaatttctttttgacccaaatcttccatgaaaaattactgacttcttatagaggtccacaggaagatgagttttcaaagcctttc

SEQ ID NO: 80562 - DNA, 601 bp, Human
atgctagcaacactatttgtttgtatgactcagtctccaggcttaactttcccttttgcataaggagtttggggatgcttgagattgttacattttcctttacatgtataatatactcactttttgtcaagaagtagacatgagcaatgagttagtggaagatacccagtcagagaaaggtttaacgaaggaaaactcccgtttgtattcgggtccaggattttagactacagaaggtacggggaaatgataacaagggcctcattaggaaggtgcttttgttttcctgcctgtgttttcygggagccattgaagtctgggtactttgcatttatcctgtggctaaaatgtctattcgctttgcagctctgggttggttttgctttagaactccgtgctgggtctgaccatcctatactggtttctctactgaagcttgatgccctgaaggcagtcaatttctttttgacccaaatcttccatgaaaaattactgacttcttatagaggtccacaggaagatgagttttcaaagcctttcccgtgcttatctggccaacgtggtgatgtgcattctggtgatactttgttatcacaagggc

SEQ ID NO: 80563 - DNA, 601 bp, Human
gctcagtgccaatcttagcatgaacttcctcgaattgtaagagcccttttcttttccagtttcatgacagctctcctccaagcctttctgaggactctggaaactatcagctgctgttggccctggttcgtagatgttacagaaattgaatgggggccaggcaggagccagggaaatcagtgagccaggcttcctccgctgtgaagtggctcttttgtacgggctgttctggccataatacctgcgtaatttttttctttcctgtctgcaacctagcctgcggggtgctttctgtttccaytgctttttctacataatgggctccctggacagtaccactctcccagacttctcatcccagctgcttcctttctgagccagtagctctcaccaaagaggccaaaagaggacctggcaatgttgagtcattgcgtgcagtatgtgagtagccagtgtgtgaacacagctgcagtgaacggaattagcaataagacacaacgcaaccaggtagcctcatttgttcagattgaggtcttcaaaaagcattttaagtttacgggtggaaaggtgtgatacctttcctcagccatcattaagggct

SEQ ID NO: 80564 - DNA, 601 bp, Human
ctggcaatgttgagtcattgcgtgcagtatgtgagtagccagtgtgtgaacacagctgcagtgaacggaattagcaataagacacaacgcaaccaggtagcctcatttgttcagattgaggtcttcaaaaagcattttaagtttacgggtggaaaggtgtgatacctttcctcagccatcattaagggctaacactcctataacaaaaacaagttaacaagagaaaaacataacacatttatttaatcagagttttacatggcacaggaggcttcagaaatgaagacccaaagacccaggraaaactatttttatgctcagatttaatgcagaatagtcagctatgaaggaatgtgattggacaaaatgggtatgatctaatggttatagactggggggtgagcggaccagcaagccctgtctgttcagattcttcttggacgctctgcatagtatttattcctcttgggtatggggcaggactcctctaaatggagggtcttcaagggagaaggaagagagtgacctttgtaggttttatgtttgctttgagggagaggagtcctagtttctaagactggctttgaggaagaggaattct

SEQ ID NO: 80565 - DNA, 601 bp, Human
ggtatgatctaatggttatagactggggggtgagcggaccagcaagccctgtctgttcagattcttcttggacgctctgcatagtatttattcctcttgggtatggggcaggactcctctaaatggagggtcttcaagggagaaggaagagagtgacctttgtaggttttatgtttgctttgagggagaggagtcctagtttctaagactggctttgaggaagaggaattctggtttctatggcttgcatccagggagaaaaaggagtgtgagaggggagggcaagagaaggcagagagaycttgcttctgaggccttccaatctcctttggttcaaagtactcagcataccaaagtgtcacacttaggggtatcatactgtgagccacaacataagtatctccattcctttttactcaatttcacataaagaaagctggaaaaggtgatccacaatgaagatgtttgtcctccttgtcttaagctgatttctatatctagaaatgtctttattgggcaaaagtgcttcctcttcagccataatgggtgcagatctgattctttcttttctctgacacttactggccctgggacagctgga

SEQ ID NO: 80566 - DNA, 601 bp, Human
gtgtgagaggggagggcaagagaaggcagagagaccttgcttctgaggccttccaatctcctttggttcaaagtactcagcataccaaagtgtcacacttaggggtatcatactgtgagccacaacataagtatctccattcctttttactcaatttcacataaagaaagctggaaaaggtgatccacaatgaagatgtttgtcctccttgtcttaagctgatttctatatctagaaatgtctttattgggcaaaagtgcttcctcttcagccataatgggtgcagatctgattctttctyttctctgacacttactggccctgggacagctggaaactcactttgactctccaaggagcacatccctaaatgtgtgatctcttgatatctctcccacttttgaaaagaactgacaagggaaaaatgttcacttacccatcagctggtttttctctttttgtttaatgtctttggggagaaagcaaagagctaggacatgaagaaaacttctgtctccactgcattttgaagttttgcaaacccagccatctttcccaagagcagagcagtagaagcaaccaggatgcaaccagggttggt

SEQ ID NO: 80567 - DNA, 601 bp, Human
caatttcacataaagaaagctggaaaaggtgatccacaatgaagatgtttgtcctccttgtcttaagctgatttctatatctagaaatgtctttattgggcaaaagtgcttcctcttcagccataatgggtgcagatctgattctttcttttctctgacacttactggccctgggacagctggaaactcactttgactctccaaggagcacatccctaaatgtgtgatctcttgatatctctcccacttttgaaaagaactgacaagggaaaaatgttcacttacccatcagctggttttkctctttttgtttaatgtctttggggagaaagcaaagagctaggacatgaagaaaacttctgtctccactgcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcct

SEQ ID NO: 80568 - DNA, 601 bp, Human
cttaagctgatttctatatctagaaatgtctttattgggcaaaagtgcttcctcttcagccataatgggtgcagatctgattctttcttttctctgacacttactggccctgggacagctggaaactcactttgactctccaaggagcacatccctaaatgtgtgatctcttgatatctctcccacttttgaaaagaactgacaagggaaaaatgttcacttacccatcagctggtttttctctttttgtttaatgtctttggggagaaagcaaagagctaggacatgaagaaaacttctrtctccactgcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaaca

SEQ ID NO: 80569 - DNA, 601 bp, Human
atttctatatctagaaatgtctttattgggcaaaagtgcttcctcttcagccataatgggtgcagatctgattctttcttttctctgacacttactggccctgggacagctggaaactcactttgactctccaaggagcacatccctaaatgtgtgatctcttgatatctctcccacttttgaaaagaactgacaagggaaaaatgttcacttacccatcagctggtttttctctttttgtttaatgtctttggggagaaagcaaagagctaggacatgaagaaaacttctgtctccactrcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaacaatttccact

SEQ ID NO: 80570 - DNA, 601 bp, Human
tctccactgcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaacartttccacttttggtgtctttaaagtgggctggaaacgttaagagcacttgcaaaacaattctcagcctccccctctctcttaaatgttattgaatctttccaaggtttccagcttgctttttatggaaacaagcacttgttttcacattaatatttcatcgctctacatagtatttatttagattgtataattaggatatttaaatataactggcctacagaagtgaagaaacaaatgcaacttgaccaatagaaacagaactgcgcaggcttaccaggaccctgcccctggcctggccc

SEQ ID NO: 80571 - DNA, 601 bp, Human
gcccccaggtatttcctggaaccattgattatggcagagcagatcttattttgctcatatgattaggaacctcaggccaacaagcttgggtaatagtgagagaaaagaagagtggtcctttgctcttctttgtctgagtgccttttgagggaaagagtagataccaccaaccatagcatctctatctctttccagcaaactacaggggtgcctgagactttagggtgggaagcaagctctcacttggaaggggtgacatccagaaccaggattaaacgctgacatttaaaaacagtaactrtggtagtcttaatagttgcacagtttacagtgaaacacttagagttcaaatttgttttactataaagtgaacatggatggagtttgggatttgattctgtcttcatagtttccctttacagttcaatatttcttagctcaaagaacacattcccttaaaaggaatccctcaaaccacttttcatttttattttcttatacaaaagggccttagggttggatgtccctatccccagaatctgaatccttttattaaagggactgtatctaggtactagccggtgccatgaatctcattttg

SEQ ID NO: 80572 - DNA, 601 bp, Human
ctcggcatttatatgaaaagacaaacaccataaaatctatgtcaaatacatgtgaaatatattctttgtgttgtgggcaggcatttgtttgaagtaaatattctttttgtagataatattttaaaaagaaagacaaaaccatatcgcattcctgaaatgtatttaccaagcatgtattttggaaaacagcccaaaggaacatatttaaggcagtgattttaatactaaactaaggaaatagtttgatgcatcagctaagctcatggatgggggtaatcacatctggtttacctcaagccasaggagaaggagtgagacttgacaatgtaacaaccattatgaggctcaagtagcgtttttggcttgtaagcatgtatgtgtgctgtgttcaattttatgttttaaatttttttaaaaaacttaaatactgctatagccccaaaatatgtaaaatatgtaaacagttggcttgatggccataagggaacacctgtccttttttttttttttttttactgtgtagcctgtgactttcactgcaggaattaaatatttttgtggataggcaaatgtacttttgtggataggtattgctgatgcc

SEQ ID NO: 80573 - DNA, 601 bp, Human
tagcgtttttggcttgtaagcatgtatgtgtgctgtgttcaattttatgttttaaatttttttaaaaaacttaaatactgctatagccccaaaatatgtaaaatatgtaaacagttggcttgatggccataagggaacacctgtccttttttttttttttttttactgtgtagcctgtgactttcactgcaggaattaaatatttttgtggataggcaaatgtacttttgtggataggtattgctgatgccttattacacagccgaaggaaataaggatctgggtaagcagttgagtcacrgcaaagagtaccgtatccaaggtggaggttcatgctagagctacaggtactaacccctcccctgcaccactgatccctagcaagggtggaagtaactgatgacttctctgcacagcccccagcacaatgtctgaaagagagacctaaagggtaactgcctgttttctcagattaatcttagaatcctagcagtacttgttacttcagtttggagatttttcttattctatttcttcacactcttacagacttcacatagcccctccctttagaataactcttgacagcattttaagaaat

SEQ ID NO: 80574 - DNA, 601 bp, Human
aatatttttgtggataggcaaatgtacttttgtggataggtattgctgatgccttattacacagccgaaggaaataaggatctgggtaagcagttgagtcacggcaaagagtaccgtatccaaggtggaggttcatgctagagctacaggtactaacccctcccctgcaccactgatccctagcaagggtggaagtaactgatgacttctctgcacagcccccagcacaatgtctgaaagagagacctaaagggtaactgcctgttttctcagattaatcttagaatcctagcagtacttsttacttcagtttggagatttttcttattctatttcttcacactcttacagacttcacatagcccctccctttagaataactcttgacagcattttaagaaatagactatttaaatcatcttgatccagtgactcaacccaaggtgtaacccgtctgctcaaatttgtggcaaatctccattgatgataacatttctgcaaatgtatgctctgttaggtgtggaagcttttcctaagtagaattggcagccacagtagtacctgcctacctagcaatttaacttaaacagtttccttttcc

SEQ ID NO: 80575 - DNA, 601 bp, Human
gcacagcccccagcacaatgtctgaaagagagacctaaagggtaactgcctgttttctcagattaatcttagaatcctagcagtacttgttacttcagtttggagatttttcttattctatttcttcacactcttacagacttcacatagcccctccctttagaataactcttgacagcattttaagaaatagactatttaaatcatcttgatccagtgactcaacccaaggtgtaacccgtctgctcaaatttgtggcaaatctccattgatgataacatttctgcaaatgtatgctctrttaggtgtggaagcttttcctaagtagaattggcagccacagtagtacctgcctacctagcaatttaacttaaacagtttccttttccaaaggtattttctattcagaatagaaataataaatatgatttcctcatcactctagatacagcctgatgagatattgttaccagatactttctcttatcaaaacaaccattattatttcataatatattccctaccctttgaatataagctccagttctaaaattttaaatgttggtatcttccacatgtcatagggaaagacttaagcctt

SEQ ID NO: 80576 - DNA, 601 bp, Human
gtgcatgcctgtaatcccagctactcgggaggctgaggcaggagaatcacttgaacccaggaggcagaggtcgcagtgagccgagatcacgccattgcactccagcctgggcaacaagagtgaaactgtctcaaaaaataaataaataaataaaaaataaaaggattcttcaagcctcttttcttgtatgtaaaagaaggaattgaaccttgaggatggttcctaagacccctaccaaatccagcagcattctctgcttctaggtattaagattctcagggaaggtttccgacattcttartagccctgaaggaggcagatctttgtaaatgcatttgctgtcctgggaaacaagatggtgttaagataaggaagctccatttctcttgcagttataacccaaggcagagcctcctgattaatacacctggcttacaactcactattttggcttaaacagaaatgtcagtgcttccaaagctttcactgagacaccttctttgaaaaaaaaagtttcttttattttaaaagaagcaaacaaactctcttcaacagctccctttatttacttatttatttatgtagctttctatgaaggctt

SEQ ID NO: 80577 - DNA, 601 bp, Human
agcaatgttgtccttcagtctaggcaatgggtgtgccccaaggccagtgtgagggtccgggagacaggaatctgtatatttcttacctgcctctcatgatttgagcaccttgctctgctaagtgtcccctgaagaaagagccacttctcccaaaggtggaagaaagtgaggccctgtgggtcgtattgcactcagatatgttggactcactgtggtatgtcttcctgcggaattttctaggaaatttttactgtacttgttctatacacacacacacacacacacacacacacacacacacacacaccctcagaatatgtgcctgtactgttcaataacttacacattgaactaggagccagggatctgggattactgaccagtggcagtggtcacttgttgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttct

SEQ ID NO: 80578 - DNA, 601 bp, Human
tgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgyggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctggggcttcctcacaacatggagactgggttccagggtgggtgatctgaaaagacatgtcaccttttatgacctgactttgcaagtcaggcagtgtcaccttc

SEQ ID NO: 80579 - DNA, 601 bp, Human
ctctctctggacagacagatttctttggacagaacagaattttttaccagattgatagaaatatattaatctaccctctcatcagctgtcaattctcagtttaggtctaaactaattctattctcaagattccaagtgagagcattatagtaaaataatacatctcttaagtcatatctacccagttcacattcagtatcctctcagttcagaatcagaagctgtcagaccaacaagtagaggttcctgcacaagcctgagagagatcctgtaacttgtgccttggaaaaacagccccacraaagaatgccagacagatcttctcttagcaaacatggtgacttgagctctctgaatttgttcccttatgctacattgtttgttttttaatctctaaaaaaactaaaaaaaatttcaggtaaattttcttcctttttcattatggtttgaattagggtttttgataactttttttccaaattttagggatgttaaaggttcaggaaagtataaagaagaaaataaaaatttcccataatactgccccacaaataataattataaatattttgatgctttgcctatttgagttatttcatca

SEQ ID NO: 80580 - DNA, 601 bp, Human
aggaaagtataaagaagaaaataaaaatttcccataatactgccccacaaataataattataaatattttgatgctttgcctatttgagttatttcatcatcattaaatgctcttttattaaaaatgactttaatggctaaatacaaatctgctgtaccagaacttatttaactattccctttattgtttgacaattatttcctctttcctatacttttaatgccatcatctttgcatgaaaaatcttttatttctatttgatatatgtgataggcattcttccatgcttattacaagggyttaataaaagttatttcaatttaaatgaacaaattatttctttttgatagattccaggaaaggaaattattgggtcttaagatatgaacaatttaaagcgcttgttatgtggtctgaaattgctttccaaaatttatgccattactatcaatctgcacgtaatttaaaaaggaaaacaggcaggaattatatgtttgggggagaaatgtaaaactgtattttaaatttgtttaatttagctctgatttcatatttgttgtagccgtaagatgaagattgagtcatttgatttcgtttaag

SEQ ID NO: 80581 - DNA, 601 bp, Human
taggagagttgaggggatacagctgaaccatgggctttgtgcgaggtcctatgaagacagagtttagactctgctctgtggtggtttcgtgcaggaaagtgacataaagaaggcccttttctggctcatagaaataagtttgaagggaaaaagtgagagaaggaaggagctctaagacttaattgttcattcatcaaatcgatcaatactacgtgcctgtcatgtgccagatactatgccaggggctctagggatagcagcaaaaagacatcatcatcctgctctttttttttttttttttgagacggagtctcgctctgtcgcccaggctggagtgcagtggtgcaatctcggctcactgcaagctccgcctcctgggttcacgccattctcctgcctcagcctcccaagtagctgggactacaggcgcccgccactacgcccggctaattttttgtattcttagtaaagacagggtttcaccgtgttagccaggatggtcttgatctcctgacctcgtgatccgcccgcttcggcctcccaaagtgctgcatcatcctgctcttatgcggcttaagctcccatgtatggtggtggtagc

SEQ ID NO: 80582 - DNA, 601 bp, Human
gagaaaagtgtgaagacataggcaagaagctattgtacttggaagatcaacttcacacagcaatccacagtcatgatgaagatctcattcatatccttttcatcttgcagatgaagcaaggcaaagttattttataaaagagagtctttaaagggtagtttttcatgcctcagaagatggcaacaaatagatgctgccgttatttatagcacagagcacctcagatctctgagattatcaggtatgaaatgttttcgctctagttttcagtaagcaattcagtattttttttcttttttcytttttttttttttttttttttgatgccttggctggagtgcaatggtgtgatctcagctcactgcagcctccacctcctgggttcaaacggttctcctgcctcagcctcctgagtagctgggattacaggtgcccgccagcacgcccagctaatttttttgtatttttagtagagagagggttttgccatgtttgccaggctggtctagaactcctgacctcaagtgatccgcccgccttggcctcccaaagtgctgggattacaggcttgggccaccgcatccggccgcaattcagtatt

SEQ ID NO: 80583 - DNA, 601 bp, Human
atgctgccgttatttatagcacagagcacctcagatctctgagattatcaggtatgaaatgttttcgctctagttttcagtaagcaattcagtattttttttcttttttcctttttttttttttttttttttgatgccttggctggagtgcaatggtgtgatctcagctcactgcagcctccacctcctgggttcaaacggttctcctgcctcagcctcctgagtagctgggattacaggtgcccgccagcacgcccagctaatttttttgtatttttagtagagagagggttttgccatrtttgccaggctggtctagaactcctgacctcaagtgatccgcccgccttggcctcccaaagtgctgggattacaggcttgggccaccgcatccggccgcaattcagtatttttaattgctaaatccaaccactaacaattaagttcagacatgcacacgaggaagccaaagaaaatgcagtttcaagtgagtgtaaatccagctctgtgtggccctggtgaaggaaaacagttgactggctcgttttcctacgagctttttcaataccaagcgtcctaaatccacctctgaatttcttta

SEQ ID NO: 80584 - DNA, 601 bp, Human
catccgtatgaagcactccattctgtgttgatctgtggacgcagtttgtcactggttagttctgctgagagcaaatgggtgggtacccagtggatgaagggatatgcagccctatatcctttcagttatttaatcacaagttgacacttctctagctaaaaacacttccctattcattcatctttctattcagtagaatgtcttttattagatgcgtttgtggcaaatttagctattttggtctttgcttgtcattgctgtcttactttttagaattccagtttttaccatactttatggsctgtgtgtgtgtgtgtgtgtgtgtgtgtgtgtgtgtgtataagtagctttgaatggccaaggattaatcttagtcataaatactcagatctgtgatttaatgatagagccaatgctacacttccttccttgttataactttacatttttgaccttgtttattaagctgggcagaaaatttcttcaacttaatctgcaatgattttcacattgctttaggtagattttgaaaagcagatattctgttcttcataatttcctgcctcttaaaaatcttgtatttaagctattatcagaaagt

SEQ ID NO: 80585 - DNA, 601 bp, Human
acgcagtttgtcactggttagttctgctgagagcaaatgggtgggtacccagtggatgaagggatatgcagccctatatcctttcagttatttaatcacaagttgacacttctctagctaaaaacacttccctattcattcatctttctattcagtagaatgtcttttattagatgcgtttgtggcaaatttagctattttggtctttgcttgtcattgctgtcttactttttagaattccagtttttaccatactttatgggctgtgtgtgtgtgtgtgtgtgtgtgtgtgtgtgtgtgtataagtagctttgaatggccaaggattaatcttagtcataaatactcagatctgtgatttaatgatagagccaatgctacacttccttccttgttataactttacatttttgaccttgtttattaagctgggcagaaaatttcttcaacttaatctgcaatgattttcacattgctttaggtagattttgaaaagcagatattctgttcttcataatttcctgcctcttaaaaatcttgtatttaagctattatcagaaagtttcccaaagaagcatacaaacatagaataaggatggcg

SEQ ID NO: 80586 - DNA, 601 bp, Human
aaacattttgactgtgtgcaaggtctcctccacgctcaaaatattgtaaccaaaagccttccaaattaaggtggatttttaagcaggaattttctcattttcttcctccttcaatttctacaacacactttcaaaggaaaagaagtacacctgtgatatgtacatttttggcatatttcaaagccctcagggcagttctgcctggccctcagtcatagacgaggtagagacactctgattctatttgtggttgtatttacatccatgtctgggaagcccttatggaattctgtttctctgsttatttggagtgcatggtgcccaattgtttagttttggtggtgcttgagggcatgctctaaatacatccaggtttgtgcacaaataccacagctccgtaggacccttgtttagttcaactttccaaattttagcgtgaacagacaaaggtaacgagagttttgggagactgtcctgcctccttggagatgttttccacttctagagctgaggggctggaagagggatcatgaggatcatggagctccactcatgtagtttatagataagaaaatccagagcctggccaggtgcggtggct

SEQ ID NO: 80587 - DNA, 601 bp, Human
aaggaagggagaaagagagagagaaagagaggaaggaaggaaggagaaagaaagataaagaaagaaaaagaaagaaaagaggaaggaaggaaggagagagggaaggagagaaaaggaaaggaaaaggaaaagaggaaagaaaaggaaagggaagggagagggaaaggagaagggaaaggaagagaagggaagaagggaagggagaagagacaagggaaaggagaagggaaaagggaaaggagaagggaagggagaagggaagggagcaaaagggaaggaaagaaagaaaggaaaggaaaggaaagaaagaaaaggaaaggaaagaaagaaaacccagagcctaagatgacagtatctaaagctttgtgtgtgatgggctggtgcagatatagtagtcacagttctttccttaggctctcacttggctttggagtgggacggggaagagttggagccccacagtgggtgggggagggcaagggcgtagacacagggctgtcctgctgctggctgagcacgaggtgggcttggcacaaggtaggcaacacagagtttctgtgtacaagcatcaaatcctttgaatcaatcttgggtatagtca

SEQ ID NO: 80588 - DNA, 601 bp, Human
gagaaagagagagagaaagagaggaaggaaggaaggagaaagaaagataaagaaagaaaaagaaagaaaagaggaaggaaggaaggagagagggaaggagagaaaaggaaaggaaaaggaaaagaggaaagaaaaggaaagggaagggagagggaaaggagaagggaaaggaagagaagggaagaagggaagggagaagagacaagggaaaggagaagggaaaagggaaaggagaagggaagggagaagggaagggagcaaaagggaaggaaagaaagaaaggaaaggaaaggaaagaaagaaaaggaaaggaaagaaagaaaacccagagcctaagatgacagtatctaaagctttgtgtgtgatgggctggtgcagatatagtagtcacagttctttccttaggctctcacttggctttggagtgggacggggaagagttggagccccacagtgggtgggggagggcaagggcgtagacacagggctgtcctgctgctggctgagcacgaggtgggcttggcacaaggtaggcaacacagagtttctgtgtacaagcatcaaatcctttgaatcaatcttgggtatagtcaaggttttc

SEQ ID NO: 80589 - DNA, 601 bp, Human
acagacattttaacaagttacatgcttacctaccatgtggatagtctattccaaggaggtacagaatggccttgggttccaaaggtgttttaaagatgttaggatgttcatccctgcgacgttgttataatgaatctgctaattttcttagataccacaggtacttggtggcatatctgttatggggggcagatacttagctactcaggtccctaaggcacaggcttcataagaattattctgcttttttgaggcctattcttgcaattaggtgcagttagcacctctattctagttttgraatttgcctaaattgtcaatagttttggaatttgcctaaaatttctatttgcctaaaattccaattgtttttcagctctttgacaacaattaaggtcaaggtcaagtgtttcaatgggcttcaactatgagcttattggattagtgatcagaaaatctgattatagctactacttagccttaagatcttgcttagatgtatcaaatgagatagtttatttttctgtaagtcagtgagaaaatgttgtaaaacacttttttttaatttatggttcaatatgaatgccagacttatatctgt

SEQ ID NO: 80590 - DNA, 601 bp, Human
gtttttcagctctttgacaacaattaaggtcaaggtcaagtgtttcaatgggcttcaactatgagcttattggattagtgatcagaaaatctgattatagctactacttagccttaagatcttgcttagatgtatcaaatgagatagtttatttttctgtaagtcagtgagaaaatgttgtaaaacacttttttttaatttatggttcaatatgaatgccagacttatatctgttttctactcagcatcttctcttggctaataagcttgtccaacttaccctgtctaaaatccaattccytccctcctctaccaaaaacaccaaacgctcattcctagtcctcttcttctcaataaaatacagatgtgtttttctaattatttgctcagataaaaaatcagggagtccttcttaatgccttttccattttccatatcccacatccagtctgtcaccatatatatgctcttggttgtatctgcaaaacacatccagaatctagccacctctcctacctccactgccactgccctgttcaagccatgattgtttcttgcctgaactattgcagtggtctcctaactggtcactctgtgcttc

SEQ ID NO: 80591 - DNA, 601 bp, Human; identical to SEQ ID NO: 38707

SEQ ID NO: 80592 - DNA, 601 bp, Human; identical to SEQ ID NO: 38708

SEQ ID NO: 80593 - DNA, 601 bp, Human; identical to SEQ ID NO: 38709

SEQ ID NO: 80594 - DNA, 601 bp, Human; identical to SEQ ID NO: 38710

SEQ ID NO: 80595 - DNA, 601 bp, Human; identical to SEQ ID NO: 38711

SEQ ID NO: 80596 - DNA, 601 bp, Human; identical to SEQ ID NO: 38712

SEQ ID NO: 80597 - DNA, 601 bp, Human; identical to SEQ ID NO: 38713

SEQ ID NO: 80598 - DNA, 601 bp, Human
caaaaaaaaaaaaagaaaaggaaattcacccaaaaaacagaactaatttaaaagctctgtgaaagaaaaggatccattttcagttcaaaaaataaataagagaaaattaagtggatacattcaaagatgataaagcaggtcaagaactcataacttaatttgctgcactcaatataaagtctattacaatattacaaaatacctttgccaataataaagtgcttgattcatacaactctaacaaataaaatactgaggttgtaatgtactgttggacttcacctaaatggattatctaacrcagtgtttcataaaatgtgttttgagaatatttcactataactgcaaaatatttataatagaatatcttatttctcaagcatgagggttctaattcatctgcctttatggaatttctatagtgagggtcaaatggtccttcaggctccaaagtctctccttagcaaaaaaaaaaaaaaaaaaaaagtcacttaagccttatgtcttttcatttctttgccgaatgtaacagaccatttgtcaacagcattttcaaaggaaggcttaaaaaaaaaaaatcaatgttctaaatgtctttatg

SEQ ID NO: 80599 - DNA, 601 bp, Human
atgcccagagttcactaatcttttcttctgcaatttttaatttgcaatcaatcccatttgggaatttctcatcttggacatcacagtttttatctccaggagttcaaattgagtctttttatacctttttactttgtttgtttttttttgtttgttttttttttaagagggtctcactctgtcactcaggctggagcacagtggcacagtcatagctcaatgaagcctcaaactcctgggctcaagccatcctcccacctcaaccttgggacttaggactatagcgtgcgccactaagccyggctaagttttttatttatttatcttttggtagactcgttatgttgctcctgggctcaagcgatcctcccacctcagcctcccaaagcactgggattataggtgtgaaccaccatgcctggcagagtctttttttatcttccatgtctctaactttttgaacacatggaatatggtatggttataataaccatttatattttattacctgataactctaacatctttatcagtcgagtcagtttcaactgatcattctccccattacagttgtgttttcctgcttttttgtatacgtcac

SEQ ID NO: 80600 - DNA, 601 bp, Human
aaaccaaaaaaggcagcaggaaaggatacatcttcagacaaaacaaaagtgaaaaggaaagcagagaaaatacatcgcagtggcaaaccaagaaactaaagatttacctacctacagaaaacagagaaactaaactgagaaagccagaggaaaaaaaagccaagtgtgattaatatcacataccttgtcttatgagtcattcctgtttcccttcttgtactatccacaggaattttctggttttttcattgttgttgttttgttttgttttttttaaattggagtttcactcttgttgcckaggctggagtacaacggtatggtctaggctcactacaacctccacctcccaggttcaagcaatccttctgcttcagcctcacaagtagctgggattacaggcgcccactaccacacctggctaatttttgtatttttagtagaaacggggcttcaacatattggccaggctggtcttgaactcctgacctcagctgatccacccgcctcagcctcccaaagtgctgggattacaggtgtgagccaccgtgcccagcctagaggaatattttcataaactattttgtaaatataagttttc

SEQ ID NO: 80601 - DNA, 601 bp, Human
gtggagacccagcacagttctcagctaactctgctcctacaaaagtggacaggaaaccaaaaaaggcagcaggaaaggatacatcttcagacaaaacaaaagtgaaaaggaaagcagagaaaatacatcgcagtggcaaaccaagaaactaaagatttacctacctacagaaaacagagaaactaaactgagaaagccagaggaaaaaaaagccaagtgtgattaatatcacataccttgtcttatgagtcattcctgtttcccttcttgtactatccacaggaattttctggttttttcrttgttgttgttttgttttgttttttttaaattggagtttcactcttgttgccgaggctggagtacaacggtatggtctaggctcactacaacctccacctcccaggttcaagcaatccttctgcttcagcctcacaagtagctgggattacaggcgcccactaccacacctggctaatttttgtatttttagtagaaacggggcttcaacatattggccaggctggtcttgaactcctgacctcagctgatccacccgcctcagcctcccaaagtgctgggattacaggtgtgagccacc

SEQ ID NO: 80602 - DNA, 601 bp, Human
ttcaactaggaacagaagagaacttccttaacgtcatatgacattttgggctcaatgaaatttttttttaaggttttaaagaaactctcctaaaaaagtttttctttagcatactgtataagaacatacatagaaataaaaactttttaaaaagagagagaacttccttaatctcataaaatacacacatgcatcacttaacaagagtctgagaaatacatcacacgacttcatcatcatgtgaacatcacagattgtagttacacaaacctagatggaatagctactacacgcctaggcratatgatatgccctattgctcctaggctacaaacttgtacagcacgttactgtactgaacactggaggcgattttaacccaaaggtaaaaatttgcatatcaaaacatagaaaaggtacagtaaaaatatggtaattataatcttatgggaccacatcatatatgtgctccatagctgatggaaacatagttatatagtacatgactatatatgaaaaacctgtcattaacatcacaggtaatgaaagacccactacttttcatctaaggtcagaaataaaacagataggtctgttttta

SEQ ID NO: 80603 - DNA, 601 bp, Human
agggtggcactggcctgtagtcccagctactcaaaaggctaaggtgggagctccaggctacggtgacccacaatcacaccactgcactccagcctgggcgacagagtaagaccttgtctcaaaaaaacaaatcctgctgagactgtagaagtgtgcttaacacaaaatgataggtatatgagatgatctgtatattaatttgcttgatttagccattccacaatatatacatatttcaaaacatcatgttgtacaccataaatatataaaattttatttgccatttgaaatatctgtatcaaaaaaaaaaaaaaatgtccaggctgcgtgcaatggctcatgcctgaaatcccagcactttgggtggtcaaggcggggggatcatgatgtcaggagattgagaccatcctggccaacatggtgaaaccccgtctctaataaaaatacaaaaattagctgggcgtggtggcacgtgcctctaatgccagctacttgggaggctgaggcaggagaattacttgaaccagggagttggaggttgcagtaagccaagatggcaccactgcactccagcctggcaacagagcgagatgctgtctca

SEQ ID NO: 80604 - DNA, 601 bp, Human
gatgctgaggaaaggaaacccttgcacatcgctggtgggaatgtaatttattacagccagtatgaaaaacagtatggaggttccacaaaaaaaaaaaaaaaaaaaaaaaactaaaaaaagaattaccatatgatccagcaatcccactactgggcatatatccaaaggaaaggaagtcagtatgtcaaagagatatctgcactcccaggttcactgtaacattattcacaatagccaagatatggaatcaacctaagtgtccatctcagatgaatggagcaaaaaagtgtggtctatatayacaacagaccgacgttcttaaaaatgaaagaaatcctatcattttcaacaacatggatgaacctggaggatattatgttaaggcaataagacagatacagaaagaccacataagcatctcacttttatgtggaatctaaaaaagccaaactcacagaagtagagagtataatggttgttaataagtgtggagggctggggacaggaaaggctggagagatgttggtgaagggatacaaaatttcagttaggaagagtaagttcaagagatctattgtacaacatggtgactatagttcat

SEQ ID NO: 80605 - DNA, 601 bp, Human
aataactcaatagtaagaaaacaacctgattttaaaatagggaaagaacttagtcatttctcaaaaagaagacataaaatggccaataagtatatgaaaaaaatgctcaccatcactcatcaccagggaaatacaaattgaagccataatgaggtattacctcatacctgttagaatgacaatcatcaaacagacaaaagataacatattggcgaggatgctgaggaaaggaaacccttgcacatcgctggtgggaatgtaatttattacagccagtatgaaaaacagtatggaggttccmcaaaaaaaaaaaaaaaaaaaaaaaactaaaaaaagaattaccatatgatccagcaatcccactactgggcatatatccaaaggaaaggaagtcagtatgtcaaagagatatctgcactcccaggttcactgtaacattattcacaatagccaagatatggaatcaacctaagtgtccatctcagatgaatggagcaaaaaagtgtggtctatatatacaacagaccgacgttcttaaaaatgaaagaaatcctatcattttcaacaacatggatgaacctggaggatattatgttaaggc

SEQ ID NO: 80606 - DNA, 601 bp, Human
agcacagcagaggaatcaaaagagtgaagagataatttatgcaacagaagaaaatatttgcaaaccgtacatcagataaggggttaatatccaaaatatataaggaactcaaaaataactcaatagtaagaaaacaacctgattttaaaatagggaaagaacttagtcatttctcaaaaagaagacataaaatggccaataagtatatgaaaaaaatgctcaccatcactcatcaccagggaaatacaaattgaagccataatgaggtattacctcatacctgttagaatgacaatcatcmaacagacaaaagataacatattggcgaggatgctgaggaaaggaaacccttgcacatcgctggtgggaatgtaatttattacagccagtatgaaaaacagtatggaggttccacaaaaaaaaaaaaaaaaaaaaaaaactaaaaaaagaattaccatatgatccagcaatcccactactgggcatatatccaaaggaaaggaagtcagtatgtcaaagagatatctgcactcccaggttcactgtaacattattcacaatagccaagatatggaatcaacctaagtgtccatctcagatg

SEQ ID NO: 80607 - DNA, 601 bp, Human
aagaaaacaatcccatttacaatggctacaaaaataaaataaaatacttaggaataaatttagccaaggaggtgaaagacctgtacattaaaaactacataaaacacagatgaaacaaattgaaataaatgaatggaaagatattcttatgttcatgaattagaagaacagtattaacatgttcatactaaccaaagctatctacagattcaatgtaacttccatcaaaattccaatgacatttctcacagaaattttttaaaatcctaaaattcatatggacctacaaaagaccccaaayagccaaagcaatctggagcaaaaatgaacagaggaggaggcttcacactgactgatttcaaaatacaattgacccttaaatgacacaggcgttagggaagccaatcccctacgcagtcaaaaacctacatataacttttaactcccccacagcctaactacaaatatgctaccattgactggaagccttatcaatgacttaaacactaaattaacacattttgcatgatatatgtattatatgctgtattttttacaataaagtaagctacagaaaagaaaatgttatttagaaaatcat

SEQ ID NO: 80608 - DNA, 601 bp, Human
acatatcttacatggaaagaactctgaagactccgccaataaactgttagaaataatacatggattcaggaaagttgtaggatataaaatcaataaacaaaaacgtgtagcatttccatacactaacaacaaactatctgaaaaagaaattaagaaaacaatcccatttacaatggctacaaaaataaaataaaatacttaggaataaatttagccaaggaggtgaaagacctgtacattaaaaactacataaaacacagatgaaacaaattgaaataaatgaatggaaagatattcttawgttcatgaattagaagaacagtattaacatgttcatactaaccaaagctatctacagattcaatgtaacttccatcaaaattccaatgacatttctcacagaaattttttaaaatcctaaaattcatatggacctacaaaagaccccaaatagccaaagcaatctggagcaaaaatgaacagaggaggaggcttcacactgactgatttcaaaatacaattgacccttaaatgacacaggcgttagggaagccaatcccctacgcagtcaaaaacctacatataacttttaactccccca

SEQ ID NO: 80609 - DNA, 601 bp, Human
aacattaaaaggacaataaaataatactggccaggcacagtatactggctcacacctgtaatcccagcactttgggaggctgaggcaggcagatcacttgagatcaggagttcaagaccagtgtggccaacgcggcaaaaccccgtttccactaaaaatatgaaaattagccaggtgtggtggcgggcgcctgtaatcccagcaactcaggaggctgaggcaccagaatcacctggacccgggaggcagaggttgcagtgagccaagattgcaccactacacttcagcctaggtaacagcragactctgtctcaaaaaaataaaaataaaaaaagaatactatgaacaattctatttccacaaatttgatcacctagataaaatgaaccacttccctgaaagccacaaactaccaaaactcacacaagaaacaatctgaataggcctgtattaaagaaactgaaccaatcaaccttccaaaacagaaaacaccaggactagatgggtttgctggtgaattttataaaacatttaggaaagaaattatacccattctgtaccatctcctacacaagatagaagcagaaggaatacttcctaa

SEQ ID NO: 80610 - DNA, 601 bp, Human
atcaatgtaactgaaaacaggaaatcaactgagaaaaatcaatgaaaaaaccaaaagctggttctttgaaaagaccaattaaatcataaacctctagccaagtagactaacaaaaagacagaggacacaaactcctaatatcagaactcaaagaaagaaaatcactacaaatctcatgaacattaaaaggacaataaaataatactggccaggcacagtatactggctcacacctgtaatcccagcactttgggaggctgaggcaggcagatcacttgagatcaggagttcaagaccagtstggccaacgcggcaaaaccccgtttccactaaaaatatgaaaattagccaggtgtggtggcgggcgcctgtaatcccagcaactcaggaggctgaggcaccagaatcacctggacccgggaggcagaggttgcagtgagccaagattgcaccactacacttcagcctaggtaacagcgagactctgtctcaaaaaaataaaaataaaaaaagaatactatgaacaattctatttccacaaatttgatcacctagataaaatgaaccacttccctgaaagccacaaactaccaaaactcac

SEQ ID NO: 80611 - DNA, 601 bp, Human
agcatttcaaatgataaactgcagtaaggttcctcatttggtccctctggttctcggcaggttgcttaggggatcaggctctgttctctgcagtgttggttgtctggatttccttttatcctgagaaaagtctctcttcccttgctctcagggtgaacgtgattatttttcaggtgtctgatgatcctggccttagatggggaccagaattacaatccaggaggcagctagcaaaacagaaccttaattcaaatgagcatgggaactggtaagtgtcaaactggagaagaaaaactgatgygacattgaagtactctaccttttctggatttcttgtttttcctctggaaggaactcatcaccgcaacaaagagtgtaaaacaaagagaaagaagggataggaggaaaggagagaaaacatcaaggcaaatcatcaagttgtatgaataatctataatggtgtagacagtaaggaacctggggacaggagctatcacttaacaaaaatgccccagtgtctacatggctccagccttagagtaaagaacagcacacaaggggtgggggatatctttgattaactagtttttggcaaatattt

SEQ ID NO: 80612 - DNA, 601 bp, Human
gtgattctcctgcctcagcctcccaagtagctgggattacaggcatgtgccaccacgcccggctaatttttatatttttagtagagacgaggtttcatcatgtttgtcaggctggccttgaactcctgatctcaagtcatcctcccatctaggcctcccaaagtgctgggattacaagcatgagccaccgcacccggccactttatattttcaaagtactattcacatactcgcagatgatccctacaacaacccagagatgtaaagtatctggcttttcttgtgtacaaatgaggaaackatctgaaaaaaaatccaacaatttgactaatgactcgagtaatgttacacagtcaaagacaaggactaagttacagcctcctaatctaatacattacgaagcccagtcatagtttcctgaaacataatgctgacccagaaatatttcatttgcttgtagtttggatatctagttcaagaaattttaaataacagtatgccagattatttatactaaaaaagaaaaaacaagttcacctaagatgtagtttcttttgcttactaggaaaattaatttgtaaaccagagtcatatgatgtaa

SEQ ID NO: 80613 - DNA, 601 bp, Human
aaggtggtttagtagcagcagggaggcccagagtaggagtacttcggttaaagagcccgtatctggtccctttttgttataacaaaaattctggggacttacagattaaaccccagatatcatgaaataaaaattcttcccatatttatctctatgattaaattactaatgaaagcaacactcagtccctttcagtacgtctgaattaaaacttgacatttgtaccgtactttatattttcttttttttcttttttgagacagagtctcagtcttgttgcccaggctggagtgcaatgtcrcgttctcagctcactgcaacctccacctcccggattcaagtgattctcctgcctcagcctcccaagtagctgggattacaggcatgtgccaccacgcccggctaatttttatatttttagtagagacgaggtttcatcatgtttgtcaggctggccttgaactcctgatctcaagtcatcctcccatctaggcctcccaaagtgctgggattacaagcatgagccaccgcacccggccactttatattttcaaagtactattcacatactcgcagatgatccctacaacaacccagagat

SEQ ID NO: 80614 - DNA, 601 bp, Human
agacacataaccaatggatgttccaaagaaaactataaaagtgacatacatgagtgaggtaaggtggtttagtagcagcagggaggcccagagtaggagtacttcggttaaagagcccgtatctggtccctttttgttataacaaaaattctggggacttacagattaaaccccagatatcatgaaataaaaattcttcccatatttatctctatgattaaattactaatgaaagcaacactcagtccctttcagtacgtctgaattaaaacttgacatttgtaccgtactttatattttyttttttttcttttttgagacagagtctcagtcttgttgcccaggctggagtgcaatgtcacgttctcagctcactgcaacctccacctcccggattcaagtgattctcctgcctcagcctcccaagtagctgggattacaggcatgtgccaccacgcccggctaatttttatatttttagtagagacgaggtttcatcatgtttgtcaggctggccttgaactcctgatctcaagtcatcctcccatctaggcctcccaaagtgctgggattacaagcatgagccaccgcacccggccac

SEQ ID NO: 80615 - DNA, 601 bp, Human
attgaatttctgatacttgtctaaaataagctctaaatgagacagacagataaggaatgactattttagtggcagtatgccttctgatgtccggtggttgatctcaggccatccagtatgagcctggaactacacatatcagagttttcccaatgtttctgctaaaggcctgctaacagcagaggactaagaggttctctataagcctcaataaaacaagacaaacagatctgacatcaaaataaacaagtaacaaaaacagtagcccaaagcacaataaatcaattatcatgtacaatcmattaatatttaagtattagcagctagaaaactagtaccaagggagagaaagtggacacactttctaaaagatatcttacatcagcagttccacaagtctcctacatactcccgcatcgatgaccgcttgaattttatcattgggtccatctgatagatatgagagggcccagcaggcatcagccagtacatcagtgtcactgacaaacagcaaccaggaaagcacattcagacatggagaaacctgtaaaaggaaaatgatgattatgaaattcaatagactaaaagccagaagtgaggt

SEQ ID NO: 80616 - DNA, 601 bp, Human
atatattccaaatgtcatgtttgcgacaatgtctctttgcatctactttgtactttaaatctcccataccttgtaactgtaccatttctccattatgttatcactttcatttttttcttctgtagtatctaaaaatttgattaatacagtctcaaattatttatgtcacgagtaaatcttccactccattatcaaaagcatcacggagatgataaagcaaaataagattgaatttctgatacttgtctaaaataagctctaaatgagacagacagataaggaatgactattttagtggcartatgccttctgatgtccggtggttgatctcaggccatccagtatgagcctggaactacacatatcagagttttcccaatgtttctgctaaaggcctgctaacagcagaggactaagaggttctctataagcctcaataaaacaagacaaacagatctgacatcaaaataaacaagtaacaaaaacagtagcccaaagcacaataaatcaattatcatgtacaatccattaatatttaagtattagcagctagaaaactagtaccaagggagagaaagtggacacactttctaaaagatat

SEQ ID NO: 80617 - DNA, 601 bp, Human
agtcaggaaacaagagatgctggagaggatgtggagaaataggaacactcttacattgttggtgagagtgtaaattagttcaaccattgtggaagacagtgtggcgattcctcaaggatctagaactagaaataccatttgacccagccatcccactactgggtatatacccagaggattataaatcatgctactacaaagacacatccatgtttattgcggcactattcacaatagcaaagacttggaaccaacccaaatgtccatcagtgatagactggattaagaaaatgtggtacayatacaccacggaatactatgcagccataaaaaaggatgagttcatatcctttgcagggacgtggatgaagctggaaacgatcattctgagtaaactatcacaaggacagaaaaccaaacactgcatgttctcactcacaggtgggaattgaacaatgagaacacttggacacagggcggggaacatcacacactggggcctgtcgtggagttgggggcagggggagggatagcattaagagaaatacctaatgtaaatgacgagttaattggtgcagcaaatcaacatggcacatgtata

SEQ ID NO: 80618 - DNA, 601 bp, Human
tctcagcactcgtattcaacacagcactggaagttctggccagggcaatcaggtaagagaaagaaataaagggtattcaattaggaaaagaggaagtcaaactgtccctgtttgcagatgacatgattctatatttagaaaactccatcgtctcagccccaaatctccttgagctgataagcaacttcagcaaagtctcaggatacaaaatcaatgtgcaaaaatcacaagcattcctatgacaaagggctaatatccagaatctacaaagtacttaaactaatttacaagaaaaaaaaamcccctcaaaaagtgggcaaaggatatgaacagacacttctcaaaagaagacttttatgcagccaacagacacatgaaaaaatgctcatcatcactggtcatcagagaaatgcaaatcaaacccacaatgagatcctatctcccgtcatcattaaaaagtcaggaaacaagagatgctggagaggatgtggagaaataggaacactcttacattgttggtgagagtgtaaattagttcaaccattgtggaagacagtgtggcgattcctcaaggatctagaactagaaataccatttgacc

SEQ ID NO: 80619 - DNA, 601 bp, Human
tgtacacccattgtcactgataaacatcttaacaagaaacagtgttttctagagcagaaaaccggtctgactagaattcgccaggctggaatttcctaatcctagcaagcctgagggcactgaaggagaccagggcgtattttatgccttatcttcaactgcaaaagacagacactcccagagcggccattttagaggccgccccctgggaatgcattcttttcccagggctgttccttgctgagaaaaagaactgagcgctatttctcctattcgcttttgcaagaagagaaatcatgaytctgttctgcccagccccgcaggcagtcagaccttatggttatctcccttgttccctgaaaatcactgttatcttgttcttttagaatgcccagatttcatactgttcaaacacacctttcacaaacaatttgtacacataatgcaatcatcacaggaccctgaggcaacatacatcctcagcttatgaagatgacaggattaagagattaaagacaggcataggaaattataagagtattgactggggaagtgataaatgtccatgaaatcttcacgatttatgttcagagactgcagt

SEQ ID NO: 80620 - DNA, 601 bp, Human
cccactgtacacccattgtcactgataaacatcttaacaagaaacagtgttttctagagcagaaaaccggtctgactagaattcgccaggctggaatttcctaatcctagcaagcctgagggcactgaaggagaccagggcgtattttatgccttatcttcaactgcaaaagacagacactcccagagcggccattttagaggccgccccctgggaatgcattcttttcccagggctgttccttgctgagaaaaagaactgagcgctatttctcctattcgcttttgcaagaagagaaatcatgattctgttctgcccagccccgcaggcagtcagaccttatggttatctcccttgttccctgaaaatcactgttatcttgttcttttagaatgcccagatttcatactgttcaaacacacctttcacaaacaatttgtacacataatgcaatcatcacaggaccctgaggcaacatacatcctcagcttatgaagatgacaggattaagagattaaagacaggcataggaaattataagagtattgactggggaagtgataaatgtccatgaaatcttcacgatttatgttcagagact

SEQ ID NO: 80621 - DNA, 601 bp, Human
agccagaaagctcgaaatgggtggatcccaccgcacctcagcaaggcctactatctctatacactccacctctgggggcagggcataggctgaacaaaaggcagcagacaacttctacagatgtaaacgtccctgtctgacagctctgaagagagcagtggttctcccagcatggtgtttgagctctgagaatggacagactacctcctcaagtgggtccctgaaccccgtgtagcctattgggggaaccagcccccaatatttcaatgtaggttcttttctattttctctaagtgttggmcagtctaagaaataaagagaaagagtacaaaagagagaaattttacacctgagtctccgggggtgacatcacatgtcggcaggttccgtgatgctcccaagccacaaaaccagcaatattttattagcgattttcaaaggggagggagtgtacgaatagggtgtgggtcacagagatcacatgcttcaaaaggcaataaaatatcacaaggaaaatgggggcagagcaagatcacaaggccagggtgagattagaactgctgatgaggtttcatgtcccactgtacacccattgtcactg

SEQ ID NO: 80622 - DNA, 601 bp, Human
cactgctagcgcagcagctggagatcgacctgcaaggctgcagcctggcggggggaggggcgtctgccattgctggggcttgagtaggtaaacaaagcagccagaaagctcgaaatgggtggatcccaccgcacctcagcaaggcctactatctctatacactccacctctgggggcagggcataggctgaacaaaaggcagcagacaacttctacagatgtaaacgtccctgtctgacagctctgaagagagcagtggttctcccagcatggtgtttgagctctgagaatggacagactrcctcctcaagtgggtccctgaaccccgtgtagcctattgggggaaccagcccccaatatttcaatgtaggttcttttctattttctctaagtgttggccagtctaagaaataaagagaaagagtacaaaagagagaaattttacacctgagtctccgggggtgacatcacatgtcggcaggttccgtgatgctcccaagccacaaaaccagcaatattttattagcgattttcaaaggggagggagtgtacgaatagggtgtgggtcacagagatcacatgcttcaaaaggcaataaaat

SEQ ID NO: 80623 - DNA, 601 bp, Human
agtaaaatacgataatagaaacatgatcatgaagttcaatatactgtttttaaaggacaaaaaaaagttaccacttcttcatacctgtgtctgaatatcatcccctgtgacaatgtttcccacagctcgcaaagcaggagaaaccactttataatcattatgcctgcaaaaacaaaaagtaatgttatagcaaacagttctatccttagtttcatttccttccaagaccaaaattaaaaaacaaaaaaattgtgatagaattttagagcagaaatgtacccatggggctaattaagggaaygcttatcatgatgatggaatgtctggtgttccctagaactgtctttccccttattttagtacatttggaaaaaactaccaatctttcctaggaatctttcccaggtattccatcacctggattccaacttttccctctcattctttagtataggtttcatttcctctttactggcttttgtatggttgctgagataattgagagcaataattaacatttacgcaacatttttaagttttataaattgtcttaattttcagacgtaaaagtgacacatcaacagctgaactaacttgaaaa

SEQ ID NO: 80624 - DNA, 601 bp, Human
tctagtaattagttacaatacaatgtgattaatattctgatggataaagaaaaaaaaataagtacctaacttaagagtttagggtcaaacagggcttctcagagaaaataatgttaataccaagacttgaagaacaagaaaacattaggagcagagaatgtggatatgtgtgaggtggcagtcagagcaaggggtagcagtggagacacatgttccaggcagagggaataaagcatgcgttaaaactctgagctgagagtggccacagccaattcaaggaacaaatatggcaaaagcatayagcatatggaggtgggtgagggacagaaagatactgatagggttcaaaaattcagagggtataaaagactccatagttgttaaaagcctctttccccttcttgtatcccagccaaccagttcccctcaaagacaaccaacattttcagttccctgtatatccttccagagaaattttatgcaaatatagtcaaacatatattcttttcttctcctattctcttctgaagtgtctgaactaagccctgcaaaggatgaatagagacagaacaacaggacttagtaactgatgatggagttg

SEQ ID NO: 80625 - DNA, 601 bp, Human
gtgtgtgtgacaaggaccaaaagtacgtaatttgatggggatctagtaacaataacaatcaagaagacccagcaacttgctatacaaactataagggagggagacaccacatgtaactgcaaagtttcatgtgtaggtaaagagaatagttatatcattacctgaaataggaaaaataaaaacttggaacttgccttgtgggggaaagaagatatactgtgagacaaacgtgagatatgcaagcagaaatatgtaagaaactactgcagatataggactgaaacttgagataggtcagaastagatgtagagattcagaacttcattgcattcaataaatattctttaagtccctatatattgtgccagaaattattagatttacagaggcacagaaataaacactgacataatccacctctagaatcttaaaatctagtaattagttacaatacaatgtgattaatattctgatggataaagaaaaaaaaataagtacctaacttaagagtttagggtcaaacagggcttctcagagaaaataatgttaataccaagacttgaagaacaagaaaacattaggagcagagaatgtggatat

SEQ ID NO: 80626 - DNA, 601 bp, Human
agcaaggaacagtcatgagaaagagaatgcgttcctagggggaggtctctaaaatggccactctgggactgtctgtcttatatggttgtggataagggatgaaataaaccccggtctcccttagcgctcccaggcctattaggacgaggaaattcccgcctagtaaattttagtcagactggttgtctgttctcaaaccctgtctcctgataagatgttatcgatgacaatgcatgcctgaaacctcattagcaattttaatttcgccccgtgctctgccatttgccttgtgatattttaytgccttgtgaagtatgtgatctctgtgacccacaacctattcgtacactccctcccctttgaaaatcactaataaaaacctgctggttttgcagcttggggggcatcacggaacgtgccgatatgtgatgtctcccccagacagccagctttaaaatttctcttgtactctttccctttatttctcagaccggccgacacttagggaaaacagaaaagaacctacatgaaacactggaggtggttcccctgataactatttcttgggtcttggtgaaacatcaaatattaacggcaacag

SEQ ID NO: 80627 - DNA, 601 bp, Human
ctatctttactttaatctcttaatcccgtcatcttcattaagctgaggatgtatgtcgcctcaggaccctgtgatgattgcatcataaagcatgtgtgtttaaacaatatgaaatctgggcaccttgaaaaaagaagaggataacagcgatgttcagggaacaagggagataaccatcaggtctgactgcctgagagctaggcggaacagagctattatttctcttcttacaaaagtgaataggagaaatattactgaattctttttctcagcaaggaacagtcatgagaaagagaatgcrttcctagggggaggtctctaaaatggccactctgggactgtctgtcttatatggttgtggataagggatgaaataaaccccggtctcccttagcgctcccaggcctattaggacgaggaaattcccgcctagtaaattttagtcagactggttgtctgttctcaaaccctgtctcctgataagatgttatcgatgacaatgcatgcctgaaacctcattagcaattttaatttcgccccgtgctctgccatttgccttgtgatattttattgccttgtgaagtatgtgatctctgtgacc

SEQ ID NO: 80628 - DNA, 601 bp, Human
gacgtcaacaaagtttgacaaagttgattactggaaagacacctaatcccggtcctgtcattttactagaggtgctcttgagcaaatcattttaattccatgagccgtttcatctttttattcaaattttttattgacaaataataattgtatatatttatgggatacaatgtaatggatgcttcaatacacacacacaaacacacacacacaaaattgtggtaaatgaaaaccttggattagatgatctctctgtttccattcatctccaaggccctctatgtctgtgttatatcttttsctacccactgttccatccttgaacattgcccaggctgaacactttggcccactgcttgtcgtccacttgagttactctcccaccaatacaaagacaaaagtaaaaaccaagtaactatttaaagaaaaatgggtatccaaaaattcatgaaaatttgaggcaatctacatgggtccactggaaaaataaatatcttacttggaaagcgttaaagccaatcgtgctcagcataaagcccatcaaaacattttgaaaatacaagacattatttgttgcaagaagtcagggaccctgaatgga

SEQ ID NO: 80629 - DNA, 601 bp, Human
ttcagcagtttgtaaaatactaatgagggctgggaaaatgttggcatctatcacagtctaaaattaaagaaaaacttaaatggaaaaaactgtgagatttataaaaatattcatgatactaattataatttctaagctagtttgactattaacaccccttctcctgtcagaaataaattgaaaagagttatgtcattatctctaacctttttttttcttttttgagatggagtctcactctgttgcccaggctggagtgcagtggtgcaatctcagctcactgcagcttccacctcctggrttcaagtgattctcctgcctcagcctcccgggtagctgggactacaggtgcacaccaccaaacccggctaatttttgtacttttagtagagacagggcttcaccatgttggccaggctggccttgaactcctgacctcaggtgatccacccacctcggcctcccaaagtgcagggattacaggtgggagccaccgcacccagcctatccctaatccttattctgtcttggtatcactgaaaacatcttccctggagtttatgatcttataatctcctattttctctgagttcttttctct

SEQ ID NO: 80630 - DNA, 601 bp, Human
gacagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattacaggcgtgagccaccgcgcccggccagggaggatcgcttgagtcctagagttcaagaccagcctgggcaatacagcgagccccccgccgcaaaaaaaattgttttaacattagctggctgtgatggggcaagcctgtacttccggctacttgrgaggctgaggtgagaggatcgctagagcctgagaagtcgaggctgcagtgagttgtgatcgcaccactgcattccagcctaggagaaggggcgagactgtctcaaaaaaaaaagcagattattaggaaacggtagaaatgcccagaggaactaaagcggacctatgtttgctggctttgaattcactgctgggaacatgtggaaactgcttcagcaaaggggtgtcagaaagaatccccggaacaagtgtcaaaacacccgtggttctttgtgcttgagttgggggcccggcctagagag

SEQ ID NO: 80631 - DNA, 466 bp, Human
tcctgcctcagcctcccgacagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattamaggcgtgagccaccgcgcccggccagggaggatcgcttgagtcctagagttcaagaccagcctgggcaatacagcgagccccccgccgcaaaaaaaattgttttaacattagctggctgtgatggggcaagcctgtacttccggctacttgggaggctgaggtgagaggatcgctagagcctgagaagtcgaggctgcagtgagttgtgatcgcaccactgcattccagcctaggagaaggggcgagactgtctcaaaaaaaaaagcagattattaggaaacggtagaaatgcccagagg

SEQ ID NO: 80632 - DNA, 601 bp, Human
atctgaatccaggccttcttactctaaatccaggactgttccaccatatcacactgcataggaattattaggccaccggacacgttctaaattactttttaaataaagaaactgctgggcacagtggctcacgcctgtaatcccagcacgttgggatgctgaggcgtgaggatcacttgaatccaggagttcgagaccaacctgaccaacatgacaaaaccccgtctcttctaaaaatataaaaattagccaggcgtggtggatcagggctataatcccagctacttgggaggctgaggcmcaagaatcacctgagcccaggagatggaggttgcagtgagctgagatcacaccactgccctccgctctccagcctgggtaacagagcaagactctgtctcaaaaaaaaaaaaaaaaaaaaaaaaaaaaaaaaaccatgagatcctgtaatataagacatatggaatagcacagggaaatttaagatgactaagattttgtaatttaggtatcaatgacaatgggtaataagacttatagtgtgggctgatgttagaaaaaaaatggttacgtttatagcatttaaacttatcaaagtcaa

SEQ ID NO: 80633 - DNA, 601 bp, Human
tctcactctgtctcccagtccagggtgcagcagcttgatcatagctcactgcagcctcaaactcctggatcctcccacatcagcctcccgttagctgggactaaagacacaagccacacacccagctaattaaaaaaaatttttttttggctaggcgttagtggctcacgcctgcaatcccagtactttgggaggccgaggcaggtggatcacgaagtcaagagatcgagaccatcctggccaacatggtgaaaccccgtctatactaaaaatataaaaattagctgggcatggtggcacrtgcctgtagtcccagctactcgggaggctgaggcaggagaatcacttgaacctgggaggcggaggttgcagtgagccgagcaccacgccactacactccagcctggtgacagagcgagactctgtctcaaaaaaaaaaaaaatttttttttagcctgggcaatgtagtgagaccctgtctctacaaaaaatttgttttacattagtcaggcatggtggcacatacctgtagtcacagctatgcagggtggtgagatggtagcactacttgagcccaggagattaaggctgcattgaagtg

SEQ ID NO: 80634 - DNA, 601 bp, Human
tctttttttttttttttttctgagacaggctcttgctctgttgcccaggctagagtacagtggcatggtctctgctcactgcaacctctgcctcccaggttcaagcaattctcctggctcagcctcctgagtagctgggactacaggtgtgcgccactaagcccagcaagactccgcctcaaaaaaaaaaaaattagccaggtgtggtagcatgtgcgcctgtagtctcagctactagggaggctgaggtgggaggattgcttgagcctaggagtttgagaccagtctgggcaacatagcyagacataatctctacaaaaaaaatttaaaaattagccaggcatggtggtgtgtgttgtggtcctacaggtactcaggaggctgaggtgggaggatagcttgagccctggaggtcaagctgcaatgattttgccactgcattccagcgtgggtgacaaagcaagactctgtctcacaaaataaaaaataaaagaggctgggcacagtggctctcccctgtaatcccagaactttaggaagctgaggtgagtggatcacttgaggtcaggagtttgagaccagccgggccaacatggtgaaa

SEQ ID NO: 80635 - DNA, 601 bp, Human
acggggcggctggccgggcggggggctgaaccccccatctccctcccgaacggggcggctggccgggcggggggctgacccccccacctccctcccagacagggcggctggccgggcggggggctgaccccccctaggaaatcttaactgaaataattggttctgtcaacagcagtggtatgttagtagctctgtcagtaatttttatctataacactaatctgccttagtaatcaatctcaagaaagattttgataaaaatagtgggtagaaatattaaaatactactgcccacccacaraacacaaaagttgtatcttaatcattcaatacattttaaaaaaagaaaaaaaaagagtaatcattcaataaatgtctgttactgaaccaaaaaatgaaaacactctcccacatttcagagaacacatcactggataattaatcaactaattcgatatatagcaaaaaagttaccttctatatactttaaaagtctctgaggaggtaataaagggaatcgaattgggtctagcacttccaccacatgttttcttctttttcccaaatctttcagaatccattgcattgcagctaagaagac

SEQ ID NO: 80636 - DNA, 601 bp, Human
tacaccgttaatgcttagtagtgtatttaacttgtaataaaatcatttgtaattcaatagcaacctaatctttcagtgcatgacaagagtaaaaacttcaaatctcaaaaccaggtctaaagtaggctggagagcaatggcacaatcctggctcaatgtagccttgacctcctggactcaggtgatcctcccacctcagcctcccaggtagcagtgactataagtgcatgccaccgtgctgggctaattttttgccttttttttttttttttttttttttttgtagagacagggtttcaccatgttgcccaggctggtcttgaattcttgtgctaaagcgatctgcctgccttggcctgctaaagtgccagaattataggcgtgaaccattgcacctggcctaaagtaattcttagaaataaatttaaacatcatttttctaatataaacataaaaactattttatactatggtaaaacatattttcagaattaagtttagaatctaaagatgattcaaaggctactcagaggccataattgtatatcaataccaaatttattttataatgaaaggatttacaggattcattgaatttttt

SEQ ID NO: 80637 - DNA, 601 bp, Human
gcacaggcctgcagtcccagctcctggggaggctgaggcaggagaatcacttgaacccaggaggcggaggttgcagtgggccgaaatcacaccactgcgttctagcttcagtgacagagcgagactccatctcaaaaaaaaaaaaaaaaatttttttttgtagagacagggtctcactatgttcagcccaggctagtctcaaactcctggtctcaagtgatcatcccgccttggcctcccaaagtgttggaattacagttgtgaccaccacgccgagcctattgttgtttttatatttctrtattacctaaactttttataataagcatattccatttaaagataagtaaaatcattctctaaaatataagaaacagacatataatcaaatatctaataatattaaattgcctaaattatttcagttgtaagtacaataatatatatactatggaaaaaaatctacgcatttcatgtaatataacttaaccatttaagattttgctccctctgaattttatagtctcatttttctacacaagttgcttatattttctccaatatgatcaaagaggaaaagtttcaaagttgaaaaatatta

SEQ ID NO: 80638 - DNA, 398 bp, Human
aaattagccgggtgtggtggcacaggcctgcagtcccagctcctggggaggctgaggcaggagaatcacttgaacccaggaggcggaggttgcagtgrgccgaaatcacaccactgcgttctagcttcagtgacagagcgagactccatctcaaaaaaaaaaaaaaaaatttttttttgtagagacagggtctcactatgttcagcccaggctagtctcaaactcctggtctcaagtgatcatcccgccttggcctcccaaagtgttggaattacagttgtgaccaccacgccgagcctattgttgtttttatatttctgtattacctaaactttttataataagcatattccatttaaagataagtaaaatcattctctaaaatataagaaacagac

SEQ ID NO: 80639 - DNA, 601 bp, Human
aatttccaggccagacgtggtagctcacgcatgtaatcccagtactttggggggccaagtcaggtggattgcttgagcccaggagttagagaccagcctggccaatgtggtgaatgaaaccttgctgctacaaaaaatacaaaaattagctgggtgtggtggcacatgcctatagttccagctactcaggaggttcatgtgggagtaccacttgagctcaggaagcagagtttgcagtgaagcaggattgcaccactgcactccagcctggatgacagggtgagattctgtctcaaaaataaaaaaaaaaaagaagaatttccaaataaagattgcaaactgaaacaagatcacaattatctaacaaaatttaaaaattaaaatagccacaaattctatacttacaacgtaacaaaaaagatataaaattatgtcattaacatttaagaatgatagacaaagcaagaaaaataaattctggtggcatgagtaccatatcctaaaaggattatgcatatgatgaggtaggttgtccttgctcaagcatgcttagctgaggaggtaaacggcatgagagtcaacctgtgttcatttgccaagt

SEQ ID NO: 80640 - DNA, 601 bp, Human
tttaatacttttttgatttagacctctttcatacacataggattcatctgcatagagaaaagatggaagttggaaaaatcaatgaagaattaaatctaagcctgaaaataaaaatcattaagaaacctacctataattagacttaattacttacggcacacaacttatgaatctaacattattttgtaaacaggcaaaatgagttttgtggtgtatttcacactaactatacagtctaaaaattgggatttttcaataaaggaagtaataggccttagtacttttaagtaccaccaccccmcgattggttttgagcttaccataagcatttgtttactggtatacataatccatcatagtgacaactattaccattaaaaaatgcaaagaataatttaaaacttctttatactatacttaaagatgagactgaataacaataccttggatttaaaaggttaccctggcttgtcaatgtcactaataagagctgtaatataaacaagtagtggccagatctattattttggaagaaagagcagacaataatttaaaaaacatacgttttacattgccagtcattagcactaaataggcctcg

SEQ ID NO: 80641 - DNA, 601 bp, Human
gcatgtttgcatagtaagtactttgaagaaaaaattcaaaatcttgtagtttaattacactttctgtttcctctactttcccccctctttctagtctctcactggtgttttcaaaaatatcacttttatgaatgcccaaaaccaaattaaatccttgaactttatccttaagctatgaatagtactaagggggctctcataagtaacaaccttcttgtctacctgggttctgaaaacattgataataaaaatagcaaaatatgaaagccaaaatatctgttttcttactgaaaaagggcaygctacagcagtcacattgttaggtctgatagcaagtggcttgttaagagcaaattccagaatgggaccgactcgtttgcaggcagtactgaactggggcctgcccaggtaagattcttgtcatggggaaacagagaactgatgccctttgccatcaggctaactcccaggaggatgaagagcagagccaaactcagcacacccagttgttttttcccatgttaccagtcaagtacatttgtccccctcagggacagcagagtgagtcaagggttggacagtggtcaggaatgtgcctagg

SEQ ID NO: 80642 - DNA, 601 bp, Human
actgaaaatcattacactgttccaatccttactgcatcaatgacctgtgctagagattgaatttggtttgataaataaattactgaaagcttgaaaaactcatctccccagagaggaagtaactcttttaatatcactaaaatcacagcatgtttgcatagtaagtactttgaagaaaaaattcaaaatcttgtagtttaattacactttctgtttcctctactttcccccctctttctagtctctcactggtgttttcaaaaatatcacttttatgaatgcccaaaaccaaattaaatcsttgaactttatccttaagctatgaatagtactaagggggctctcataagtaacaaccttcttgtctacctgggttctgaaaacattgataataaaaatagcaaaatatgaaagccaaaatatctgttttcttactgaaaaagggcacgctacagcagtcacattgttaggtctgatagcaagtggcttgttaagagcaaattccagaatgggaccgactcgtttgcaggcagtactgaactggggcctgcccaggtaagattcttgtcatggggaaacagagaactgatgccctttgcca

SEQ ID NO: 80643 - DNA, 601 bp, Human
aaatagtgtctggttcccaaactcctgtgcctcttctttcaggagggatgtggagaggaattggccaaatcgaatggtggcccctgtgtaggcattaaagtggacatccttcgtcctataatgcacctcatagcacagagtgccattctccatgatgctgtctttcctcagcagctggattgctgaggtgaggtagtagtgtaaatatttgaagtggaatgaacgttcatactgctgtggagtcctggcaacagaggccatggctctagtaaagtcagaatgaacattgctgttcaatgtrtaaaacaaaatagccacagcgtgtgtggtagtcatgttctggggtagaacttttccttggttaagccaggctaagtgggctttttgccacatcctaaaataattcttctgggcttctatgtcttttgtgaaataatccccttgagttagtttctccataacctgtttgctacagccttggtactgatcatcaaaagaacctggtgcgaagtcgaagtcgattttaattgcaacctgtaaaaaaagaaaaatcttgagtttaatttttcaaatcagatggtgaatgtggttgcagatttgc

SEQ ID NO: 80644 - DNA, 601 bp, Human
gagaaaaaataacttttataaaagagcagtggtctgtgatcctgagtggcctcaatttagataaagaataccttttagcagctgacagttatatgtgctcaggttcccagttgacctcaactgcaaccagtctcctcttgggtggtagctcatatttataactttaaacagctcatagggagggatcaagacttccttcttgagggagaagtactgtacaggtgcacccaggcaggtgaatatggtaaatagtgtctggttcccaaactcctgtgcctcttctttcaggagggatgtggaraggaattggccaaatcgaatggtggcccctgtgtaggcattaaagtggacatccttcgtcctataatgcacctcatagcacagagtgccattctccatgatgctgtctttcctcagcagctggattgctgaggtgaggtagtagtgtaaatatttgaagtggaatgaacgttcatactgctgtggagtcctggcaacagaggccatggctctagtaaagtcagaatgaacattgctgttcaatgtataaaacaaaatagccacagcgtgtgtggtagtcatgttctggggtagaactttt

SEQ ID NO: 80645 - DNA, 601 bp, Human
gtctgcaattttttacataataatttcactgcagaacttattgtcctggaggtaatggagtaggaagaaaagagaagtcaataaataaagtggattttctctaatctatcagttccatcattaccgaaggctagttttcatgtttttgatctttccccaaaaacccactgagaaaaaataacttttataaaagagcagtggtctgtgatcctgagtggcctcaatttagataaagaataccttttagcagctgacagttatatgtgctcaggttcccagttgacctcaactgcaaccagtytcctcttgggtggtagctcatatttataactttaaacagctcatagggagggatcaagacttccttcttgagggagaagtactgtacaggtgcacccaggcaggtgaatatggtaaatagtgtctggttcccaaactcctgtgcctcttctttcaggagggatgtggagaggaattggccaaatcgaatggtggcccctgtgtaggcattaaagtggacatccttcgtcctataatgcacctcatagcacagagtgccattctccatgatgctgtctttcctcagcagctggattgctga

SEQ ID NO: 80646 - DNA, 601 bp, Human
gtatatcacttagtacttttgagtgtatacatttgttcatatttccatttctcgttagactaaaaatcctcctaggttataattttgctttattcattctgtatttccagggcccccatcacaatagaagatgattaatgaacagaaaattaatgaataaatatcttgcctcttgctttacttttagaactccttatccatgtaatgacaatgagaaaagcaatgagtttgagggagaaggtaaaagtgctatctttatgctccaccttccagtcaagctttactctgtctgtctgcaatwttttacataataatttcactgcagaacttattgtcctggaggtaatggagtaggaagaaaagagaagtcaataaataaagtggattttctctaatctatcagttccatcattaccgaaggctagttttcatgtttttgatctttccccaaaaacccactgagaaaaaataacttttataaaagagcagtggtctgtgatcctgagtggcctcaatttagataaagaataccttttagcagctgacagttatatgtgctcaggttcccagttgacctcaactgcaaccagtctcctcttgg

SEQ ID NO: 80647 - DNA, 601 bp, Human
gaagccttcctcacttttcctggagagaatgagtagctccctgcactgagcagccacagctgtttgcttaaatatttggtatatcacttagtacttttgagtgtatacatttgttcatatttccatttctcgttagactaaaaatcctcctaggttataattttgctttattcattctgtatttccagggcccccatcacaatagaagatgattaatgaacagaaaattaatgaataaatatcttgcctcttgctttacttttagaactccttatccatgtaatgacaatgagaaaagcartgagtttgagggagaaggtaaaagtgctatctttatgctccaccttccagtcaagctttactctgtctgtctgcaattttttacataataatttcactgcagaacttattgtcctggaggtaatggagtaggaagaaaagagaagtcaataaataaagtggattttctctaatctatcagttccatcattaccgaaggctagttttcatgtttttgatctttccccaaaaacccactgagaaaaaataacttttataaaagagcagtggtctgtgatcctgagtggcctcaatttagata

SEQ ID NO: 80648 - DNA, 601 bp, Human
cacaggaacttattggaagacacattcaaaccacagcaaggtattctttgcttaaaatgacttttctttcattgaaaacccccattctcacgacaagttccatatggctattatgaagccttcctcacttttcctggagagaatgagtagctccctgcactgagcagccacagctgtttgcttaaatatttggtatatcacttagtacttttgagtgtatacatttgttcatatttccatttctcgttagactaaaaatcctcctaggttataattttgctttattcattctgtatttccrgggcccccatcacaatagaagatgattaatgaacagaaaattaatgaataaatatcttgcctcttgctttacttttagaactccttatccatgtaatgacaatgagaaaagcaatgagtttgagggagaaggtaaaagtgctatctttatgctccaccttccagtcaagctttactctgtctgtctgcaattttttacataataatttcactgcagaacttattgtcctggaggtaatggagtaggaagaaaagagaagtcaataaataaagtggattttctctaatctatcagttccat

SEQ ID NO: 80649 - DNA, 601 bp, Human
ttttcttaaaaaatgtttaacttttttttgtattttgatatctctaaattttcctgcttcagttcatttttcacagtgtcatcagagccctttctaagatgttgaccaaattgatttctactccttaaaaacttctaattacttcttattacctacagcataaaattaaaaggtccttagcatgaaatacaagaccttttataatgaagccccatcagaattctcctacctggataaatcccctcctcccttcctactcctattcttttcccatatcctacacatcctacacaccagccayccagaatttcagagtccctgaagacaccaggctgtttgaaatccttgtgattaacatatgctgtgtcttagtctgttttctgttgcaataacagagtatcacagactgcgtaatctgtaaagaaaataaatttatttctcacaattctggaggatgggaagtccaagagcatggctccagcatctggtgagggcctttatgctataccatagcatggtggaagagaagttggtacacaagacagagagaggctccagtgatcagattctctttacaatgacacactctcacaataactaa

SEQ ID NO: 80650 - DNA, 601 bp, Human
cagccatgtttttcttaaaaaatgtttaacttttttttgtattttgatatctctaaattttcctgcttcagttcatttttcacagtgtcatcagagccctttctaagatgttgaccaaattgatttctactccttaaaaacttctaattacttcttattacctacagcataaaattaaaaggtccttagcatgaaatacaagaccttttataatgaagccccatcagaattctcctacctggataaatcccctcctcccttcctactcctattcttttcccatatcctacacatcctacayaccagccatccagaatttcagagtccctgaagacaccaggctgtttgaaatccttgtgattaacatatgctgtgtcttagtctgttttctgttgcaataacagagtatcacagactgcgtaatctgtaaagaaaataaatttatttctcacaattctggaggatgggaagtccaagagcatggctccagcatctggtgagggcctttatgctataccatagcatggtggaagagaagttggtacacaagacagagagaggctccagtgatcagattctctttacaatgacacactctcac

SEQ ID NO: 80651 - DNA, 601 bp, Human
tggatgccagtttgaacacttttgcaacactactgccctgaaatgttgagaaatgctgagagcctgaattataaatcatagcaataatgataaagcgaagacaaatttggggatatattgaaggtagaccctgcaactgggttccagctgactgtgagtgtgaataaatttacatatgaacagtcttttttttttttttttctgaatcaaaaagggcacaggatttgctacacaactacccctccatgaaatggctaggtggcaacataaaattcaatcagccatgtttttcttaaaaaawgtttaacttttttttgtattttgatatctctaaattttcctgcttcagttcatttttcacagtgtcatcagagccctttctaagatgttgaccaaattgatttctactccttaaaaacttctaattacttcttattacctacagcataaaattaaaaggtccttagcatgaaatacaagaccttttataatgaagccccatcagaattctcctacctggataaatcccctcctcccttcctactcctattcttttcccatatcctacacatcctacacaccagccatccagaatttcaga

SEQ ID NO: 80652 - DNA, 601 bp, Human
tggcatgatttcagcttactgaaacctccgcctcctggattcaagcgattctcctacctcagcctcctcagtagctgggactgcatgtatgtgccatgatacctggctactttttgtatctttttgtagagacgaggtttcaccatgttggccaggctggtctcaaactcctggcctcaattgatccacccacctcggcctcccaaaatgctgggattacgggtgtgagccaccgcacttggccaataattttacattttatttcattttcacaaaagtcttctgaggttctgttacgatrattattaggtagatgaaaaaagagtttaagcaacttgaccaagaacacatagctattaagtggtacagtgggatataaattcaaacagagtgggtctgggctcaaactgcctgcctgcctagttctcaaatactagttcctcaaatactagtcgagttcctgcccccagggagcttatagagcgacacaagattattgattcccttaagtgtgattggtgattccaaatatttcattaagaccaaccgaactgtcagaatttagtgatctatgtggctaccccagctaaaccttaactca

SEQ ID NO: 80653 - DNA, 601 bp, Human
gctaacactaatttaccattattatatgctatagaatatataaataattttatttatttatttttcttttaagatggagtctcactctatcgcccaggctggagtgcagtggcatgatttcagcttactgaaacctccgcctcctggattcaagcgattctcctacctcagcctcctcagtagctgggactgcatgtatgtgccatgatacctggctactttttgtatctttttgtagagacgaggtttcaccatgttggccaggctggtctcaaactcctggcctcaattgatccacccrcctcggcctcccaaaatgctgggattacgggtgtgagccaccgcacttggccaataattttacattttatttcattttcacaaaagtcttctgaggttctgttacgataattattaggtagatgaaaaaagagtttaagcaacttgaccaagaacacatagctattaagtggtacagtgggatataaattcaaacagagtgggtctgggctcaaactgcctgcctgcctagttctcaaatactagttcctcaaatactagtcgagttcctgcccccagggagcttatagagcgacacaag

SEQ ID NO: 80654 - DNA, 601 bp, Human
cttagaggtatattcaccatcattcattcactcattcaacaaaataggctgggcacttctatgtgccagaggactgaagttagtaatagctaacactaatttaccattattatatgctatagaatatataaataattttatttatttatttttcttttaagatggagtctcactctatcgcccaggctggagtgcagtggcatgatttcagcttactgaaacctccgcctcctggattcaagcgattctcctacctcagcctcctcagtagctgggactgcatgtatgtgccatgataccyggctactttttgtatctttttgtagagacgaggtttcaccatgttggccaggctggtctcaaactcctggcctcaattgatccacccacctcggcctcccaaaatgctgggattacgggtgtgagccaccgcacttggccaataattttacattttatttcattttcacaaaagtcttctgaggttctgttacgataattattaggtagatgaaaaaagagtttaagcaacttgaccaagaacacatagctattaagtggtacagtgggatataaattcaaacagagtgggtctgggctc

SEQ ID NO: 80655 - DNA, 601 bp, Human
tcagattgcttagaggtatattcaccatcattcattcactcattcaacaaaataggctgggcacttctatgtgccagaggactgaagttagtaatagctaacactaatttaccattattatatgctatagaatatataaataattttatttatttatttttcttttaagatggagtctcactctatcgcccaggctggagtgcagtggcatgatttcagcttactgaaacctccgcctcctggattcaagcgattctcctacctcagcctcctcagtagctgggactgcatgtatgtgccrtgatacctggctactttttgtatctttttgtagagacgaggtttcaccatgttggccaggctggtctcaaactcctggcctcaattgatccacccacctcggcctcccaaaatgctgggattacgggtgtgagccaccgcacttggccaataattttacattttatttcattttcacaaaagtcttctgaggttctgttacgataattattaggtagatgaaaaaagagtttaagcaacttgaccaagaacacatagctattaagtggtacagtgggatataaattcaaacagagtgggt

SEQ ID NO: 80656 - DNA, 601 bp, Human
tgtagtctaaggctcagattgcttagaggtatattcaccatcattcattcactcattcaacaaaataggctgggcacttctatgtgccagaggactgaagttagtaatagctaacactaatttaccattattatatgctatagaatatataaataattttatttatttatttttcttttaagatggagtctcactctatcgcccaggctggagtgcagtggcatgatttcagcttactgaaacctccgcctcctggattcaagcgattctcctacctcagcctcctcagtagctgggactrcatgtatgtgccatgatacctggctactttttgtatctttttgtagagacgaggtttcaccatgttggccaggctggtctcaaactcctggcctcaattgatccacccacctcggcctcccaaaatgctgggattacgggtgtgagccaccgcacttggccaataattttacattttatttcattttcacaaaagtcttctgaggttctgttacgataattattaggtagatgaaaaaagagtttaagcaacttgaccaagaacacatagctattaagtggtacagtgggatataaattc

SEQ ID NO: 80657 - DNA, 601 bp, Human
gggaaatggtagctatctagaaagttgggtctggggagagtccactgatcttacttcctccctgttaaggatcccagataagaaagacacactacctccttcctcttattgttcatgtatggctcagtccaatactgctccagaatgttggggtaagtactacttatcagttaaaataaatcactttaaggacctttctgatgttccttcgcttactgattgagagaaaaacaaagaaacaaagaaacaaacaaacaacactgtagcgaataactgaaaacattctgaaggcaatcaaactttttttttttttttgacggagtctcattctgttgcccaggctggagtgcagtggcgcgatcttggctcactgccacctctgcctcctgggttcaagtgattctactgcctcagcctcctgagtagctgggattacaggctcgtgccaccactcctggctaatttttgtatttttagtagagacggctttcaccatgttggtcaggctggtctcgatctcctgaccttgtgatccacctgcctcgacctcccaaagtgctgagattataggtgtgagccactgcacctggctggcaatcaa

SEQ ID NO: 80658 - DNA, 601 bp, Human
gaagattacagtttcgtgaggagttagatatcagtgttccagaacaccatctgtgaattccctaggctggggttagtggagcagtgaagtgggaaatggtagctatctagaaagttgggtctggggagagtccactgatcttacttcctccctgttaaggatcccagataagaaagacacactacctccttcctcttattgttcatgtatggctcagtccaatactgctccagaatgttggggtaagtactacttatcagttaaaataaatcactttaaggacctttctgatgttccttcrcttactgattgagagaaaaacaaagaaacaaagaaacaaacaaacaacactgtagcgaataactgaaaacattctgaaggcaatcaaactttttttttttttttgacggagtctcattctgttgcccaggctggagtgcagtggcgcgatcttggctcactgccacctctgcctcctgggttcaagtgattctactgcctcagcctcctgagtagctgggattacaggctcgtgccaccactcctggctaatttttgtatttttagtagagacggctttcaccatgttggtcaggctggt

SEQ ID NO: 80659 - DNA, 601 bp, Human
ctggctccaaagtttattcactttccaccatgccgtgtggtctcccagatttattcaatgactcattctttcatccatttatctgagacagacactctacttcaaggtcattgtgatgccacaaatagggtaaactaattttagataattgaagcccagagtaaaagaaaacaggcaaaatagaaagctaataaaataaataataataatgataatagtatcttaaaagttttgagtacttaacatttgtcagatactattctaagagattttacatgcattcattcattttctccccacyagaatcgtacaggtttttaaaaagtgaagtttacatgtaaaaccaggctgactacaaacaattgcctatatttctctagaaacatgttaagaattttgattatgtgaaacattttaacaaataaatccctgttctttgtgaatccaatgatatagaacagagcatgtatttgtgtgtctacagatttttggcataggttattttgctgaaagaagcaagatttaagggcaaataactaacattctgttaacatattttgagtcttccaatgggcatgaagacacctgtttctatggcaac

SEQ ID NO: 80660 - DNA, 601 bp, Human
tgcaaagtactttcccagagtttctcagttgtgtttgaaaggaggcagagacaccaatgctatcacaacattcccacaagatgagtatcacttccattttataaatgaagaaacaggctcagaggttaagtcatttgcacaaggtcacctagctactaacatatacccaaatctttctggctccaaagtttattcactttccaccatgccgtgtggtctcccagatttattcaatgactcattctttcatccatttatctgagacagacactctacttcaaggtcattgtgatgccacaartagggtaaactaattttagataattgaagcccagagtaaaagaaaacaggcaaaatagaaagctaataaaataaataataataatgataatagtatcttaaaagttttgagtacttaacatttgtcagatactattctaagagattttacatgcattcattcattttctccccactagaatcgtacaggtttttaaaaagtgaagtttacatgtaaaaccaggctgactacaaacaattgcctatatttctctagaaacatgttaagaattttgattatgtgaaacattttaacaaataa

SEQ ID NO: 80661 - DNA, 601 bp, Human
gaatattacctagcaaaaacttagcacccgaaaatgaaaagcgttattccttctgcctcttcctttgtttctcttcttactatcaatttcactgaagcacatgcttgtgccattaaaccattatcccacttccatgtgcaaagtactttcccagagtttctcagttgtgtttgaaaggaggcagagacaccaatgctatcacaacattcccacaagatgagtatcacttccattttataaatgaagaaacaggctcagaggttaagtcatttgcacaaggtcacctagctactaacatatrcccaaatctttctggctccaaagtttattcactttccaccatgccgtgtggtctcccagatttattcaatgactcattctttcatccatttatctgagacagacactctacttcaaggtcattgtgatgccacaaatagggtaaactaattttagataattgaagcccagagtaaaagaaaacaggcaaaatagaaagctaataaaataaataataataatgataatagtatcttaaaagttttgagtacttaacatttgtcagatactattctaagagattttacatgcattcattcat

SEQ ID NO: 80662 - DNA, 601 bp, Human
tgattttattatgtcaggttaaagtaactaactctgttgatactttttctctacctcttttatggccattatcatttctacctggcattattattattattgttgttacatggaccatatatttaggaaaataaatgaaagacagctgtgcattaattacaaactaaagttttatttgaggatacctcacattttttttacttttgtagttgtctttagttttctattcaactatctcttcaaagtttttaattttctctttacctttttacaggatttttaaaattggagaatgtgatcmattgatgggttgtgacatcagcttaggaggtcatagccatcattgtttaataatgtaataaaataagttagaatagaaacactagcattaacactgcctatgaaaagggtaactgttgtattttatgaatatgtgtgtatttgcatatttatgtgtgtgtgaactgatttataatgtaaacagtcatagtcaagaagcttaaaactaacggtagtttctcagctatatttgttgaagaatggatgaatcccctgaaaccagtctatggagaatattgtcctggaattcttattagaaaac

SEQ ID NO: 80663 - DNA, 601 bp, Human
cctccttttggctctgaatctggtcaaaccttactgcctccactctaccaccttcatctctcaactgaatgattgaaatagccccctacttggtttctctgcttacctcattacagtttatcctctactgggctgctaggtcagttttgacacaatcttctatgttttctgcccaaaacctctcagtggtatcctatctaagaggaaaagccaaagtccttacaactgccttcaaggtcctatgtgatcgaatctacatcatcttctgtcttcgctttctattatttttctctcattcccrtacactggcatccttgctgttgcttcttacttgagacatttgcacttgctgtgctttcttcctggaatgctctttcctcagatatacatgggactggctctctcatctcctttcaaccttggctcaaatgtcaccctctcagtgaagtttcccctgatcacccagtttaatattgccactccttcccatagtgttcactgtctccttactctgctttatttttcatcttagtatgtaccacctactaactacgacataatttacttatttattttgtttatttctgcctcacatcaatag

SEQ ID NO: 80664 - DNA, 601 bp, Human
tgggagtgtcctgaggtttgatccttggacattttctctcctttatttatacacctttgtggggagctcatccagtctcttggctttaaataccacccataacccactgacctcaaatttatctttccatcctgggtcactcggaattctacacttgtgcatcaactgtccactcaacatctctgcttgggttactattgcacagctcagatataacatgtcaaataccaaactcctgctcttaaatctactccatccccaggcttctccatctcagtgagtgccacctccatcctttcakttactctagccaaaccttggagtcattcttcactcttctttttccctcacttttcacttccagtgtgtcaggacctccttttggctctgaatctggtcaaaccttactgcctccactctaccaccttcatctctcaactgaatgattgaaatagccccctacttggtttctctgcttacctcattacagtttatcctctactgggctgctaggtcagttttgacacaatcttctatgttttctgcccaaaacctctcagtggtatcctatctaagaggaaaagccaaagtccttacaact

SEQ ID NO: 80665 - DNA, 601 bp, Human
ttttgtgctaggatctatttcgagcccttgctatatattaacttaagcctcacaacaaacctatgagatttttattctcaatatccttggtttttacttgatgagattgtgacacagagatgagaaaaaacttgccagtgtcacacatcttgtaaatagtataggcaccattcaaacttggccagtttgtctcaattctgcattcttaaccactaacctgtttgtctgtgtattacatgtccatccatagaatttttcattacaaggtgagcaagaaatattcacacaatcctgtttggattgtgtgtgtgtgtgtgtgtgtgtgtgtgtgtgtgttctaactacacatatacacctttcacaggaaatgtgggacaggttagcagccagttaggtgtggaagcaaaactggaaaataaaaaaaaatattgtcagatataactaataattggccatataatggggtggggactgaaatgagatgggagatggaaaccctgtaaaaaatagtctaaataaagactggaatctctttgcagccagttttcactattgtttaaggtagaaaagatgtttctgggaggaagagattcaactctaa

SEQ ID NO: 80666 - DNA, 601 bp, Human
taaaaaacaaaacaaaggaaatattttaggtagcagagttttttttaaaactacctcatctatccattgatccacttacttaacttagaaaattcctaataaaaacatttgaagttagctacttaaaacacattattttagatttttctaacataacttgcttattttgcagatgatgaaacagacaccaagaggttaaaagatgtactcccaggtaacccagccagctggtggtagagatctaattttccatctttatcatcaccagcagcataatcactgttagcattatccccatctyaattatcatcatcttcatcaccattatgaaagttaacacagactgaatgctgattttgtgctaggatctatttcgagcccttgctatatattaacttaagcctcacaacaaacctatgagatttttattctcaatatccttggtttttacttgatgagattgtgacacagagatgagaaaaaacttgccagtgtcacacatcttgtaaatagtataggcaccattcaaacttggccagtttgtctcaattctgcattcttaaccactaacctgtttgtctgtgtattacatgtccatcca

SEQ ID NO: 80667 - DNA, 601 bp, Human
atagaatagtaatgatgttgaataaaacacagaatttctcaatacattgaagtagaaggaggttccttaaataaggcacaaaaaggacaagccagaaaaaaaaaatttgtcaaatgtgattgcatgcatattctcaatttctttgtaggaaacacacacatccgtgcacacacacacactaaacaaagtgattatacaaggcaaaaactgggcagatacctgcaatacacacacacacacacacacacacacacacacacacacatatatatatggctatacctgctatatatatatatakagagagagagagagagagagagagctaatagaggttttgcttttggaatacatggagaaccatgtatcaataagaaaacaacagtctatttgaaaagtgtgcaaaagatgtgaatgagcaatttgctcaaatatccaataaacataaaaaagatgtttgacattattagcaattaatgacttccagagcagcaacatataaagtggaagaaataagccaaagaacaggaaaagatgtttatgagctgaaaataactgattgtgaattttagggaagcttgaatacccccatcagtagagt

SEQ ID NO: 80668 - DNA, 601 bp, Human
tatttctggattctttattctgtccatcaacctatttttgtaacttgttgccaaaatcacgttgtagtaatatagttgtttatgtatagtatccaaaataatacacaaaacattataaataataattcaacagtttataactataagattaatatacagaaatgcattcctttattttagtaccactccaagagagaaaaaaattacataaaaaaagtaatttccaatagcaacaaaactacaaagtacataagaacatcgaatacaatatatttaagagttttaaagggaaccttataamactttattgggagatttaaaggacctacttaagtgggtgtatgtctgatattttaaatggaaagatttgataaaatgaagacagcagtgttgtcaaattaatctataaactcctatccaaaatctcaaagggtttttcatagaatttatcagaatgatcctaaaacctaaatgaaaaaaataaagacaaaaacctgcaaaacaagttgaatatgtttatcaggatgtactatccctactactaggtatcaatacttactacaaatgtataattattaaatcagtatggcagtggcgtaga

SEQ ID NO: 80669 - DNA, 601 bp, Human
gaaaacatgaggtgtgtaacaatatcccatgaaactccaatgcttcacactgacattcttctaggtcaacaccagcattctcttgaccttcctttcactgttcctcctctcccttccagcccctctgtacagtcttgagttaggtctaggcccacacacttccccactctgagctgcggtctcttcctctgtaaaatgtgatgattcagaacctctcctggccccaagcgcagttccaggcgctgagcacaccatgctgttccctacaaagccgactctttgtcccttccccattatcacrgatacttgccaagaggtggcaagaaaggctcttcccaggccaaaatgcagctgctattatcaagcaggtcaggccccaagtgccacaactcccttctcctaaatctcgttttcccaaggaaccccaaacaatggcattggcgatgagcggccccgcacgcgtaggggcgcagccgctaaggaggggaaggggcctctccagctgcgcccgcgacgactcccgcgcacggaacggaaccactgggccgcagcgaccacaggggagttcttcgccggccgcaggttcaaagcgatctgcaat

SEQ ID NO: 80670 - DNA, 601 bp, Human
acctcccaagtagctgggattgcaggtgcccaccaccacacccagctaattttgtatttttagtagagacggggtttcaccatgttggtcaggctggtctcgaatccctgacctcatgtgatctgcccgcctcggcctcccaaagtgctgggattacaggcatgagctaccagacccggctgttgtggctttctttacagaaaagtctccaaggagaacataaactctaaaaccccaaatccaagaaattcaacacaacccagttgtggctttctttacagaaaaatcttccaagtagaargaacatgaaagtctaaagccaaaaatccaaaaaattctttatagagataaaaaaaaaaaccccacaacagagcaaacaaaccaaatcactgcaaaccagtgctaagaaaaatctttaaaagcagccagagaccaaagatccaccacccaaagagaggcaagatgccctggggacctaggcccacagaaaccacagcaggagggggaggcagaggcccctgtacactctcctcactaggacagttcggtcctccctccactcagaggtgagaccaaggacatactgtggtgtggggcggaa

SEQ ID NO: 80671 - DNA, 601 bp, Human
ggcacagccatcattaaccccaaagtccatgaacttgcaaagagtctggaggggctgcccaggcagaggtgacaaatgccatcggtggcagggacagtagtggacatagaggaaagagtgcacacagacagaatcccagacagacaggaatccagtgtaatgggggaggggagtaaaaacaagagaggtactgctgaattaatattgtaatatgattacaaaatgtaggagagttgaaataatatagatccattcatcaccattcactctttctgctgtgcaggacgaggctgtgccgtcygtgggcctctctgattgagggagaatgggcgtgtggccagagatgcacagctgtgttgggccacagaaatgggctcatgggggtgtccatgggcatggttaagagagagaaggaaaacaagaagaagggaggtcaggggtttggcttatttcagttcttgtcccattgaattctagggaccctgcctcctcccggacatgagccattggcggggtttccctgtcttgtgactcacccacctgtgattcaggctccttgctttacaccaagtttgagcataaaacctgctaatatttctcg

SEQ ID NO: 80672 - DNA, 601 bp, Human
atcatcatttccctcagatctgcctcagctgccacttgcctccttcacgataatgcaacctgaccctcaccctaaccactaggacccatcccgaatgctgtccaggccacacctgagtgcacccacctagtccactctccactgggtgaacaatgatctttaatgggtggatctgatgagggatgtccccggggaaaacttgacaatggccttggtgactctggacttgggtgatcctccgtactctattcagatcctctgttctgtcctcagcctgcctgccacactccccacctctcaygtttaacacactctatgagcaggctgaggacacaacgtctgggttagtgcagcttcctagaatccacgttactcattcattcattcatggaaggcatgtaggcgcctggcgaccgcatatgcaaggagccgtggagtatcgggaacatggcacggcccttcctttccttagcacagtttccattcacaggagctgaggcacagccatcattaaccccaaagtccatgaacttgcaaagagtctggaggggctgcccaggcagaggtgacaaatgccatcggtggcagggacagtagtgga

SEQ ID NO: 80673 - DNA, 601 bp, Human
tccttaagatccatgttcccagccaggcaaggtggctcatgcctgtaatcccagcactttgggaggccaaggcggtggatctcctgaggtcagtagtttgagactggcctggccaacatggtgaaacccggtctctactaaaaatacaaaaattagctgggtgtggtggcaagcgcctgtaatcccagctgttcaggaggctgaggcaggagaatcgcttgaacccaggaggcagaggttgcagtgagccgagattgcgccattgcactccagcctgggcagcaacagtgaaactgtctcaaaaaaaaaaaaaaaaatccatgtttccatttcatttcatctctattcagattgaaatcttttagcattttgtgtactgcaggtctatgagcaatgacgtgcccatactgtctccaatagcacattcaggttcctaattcttaaagccatttatgcccatttactctttcttatttggtaatgacctcacccaagtctcagattagaaacactagaatccaccacaaacctctttcctcttcttaccaaacccattgcatcaccggcctgcgttatcatcatttccctcagatctgcctca

SEQ ID NO: 80674 - DNA, 601 bp, Human
tttacagtccagatgctcttatttctttttcttgcctgttttggctagaacttccagtactatgctgagtggcaaaggtgggtagatatccttatgttgttcttaatcttaaaggaaaagctttccgtctttcaacactgagtatgatgttagctgtggggttttcttacatggcttttatgatgttgtggaagttttcttctattcttagtttgctgggtgttttcatcatgaaagggctttgaattttatcagaggctttccctgtatcaactcagatgatcatgtgtctttttccccyttcattctattaatgcaatgtattacattgttcaattttcatttgttcaaacattcttgcattccggaaataaatccaacttggtcatggtgtataatccatctaaggtactgttgaattctctctgatagtattttgttgaagatttttgcatcagttagggatactgggatatagctttattttcttgtaatatctttatctgcttgggtatcagagcaatgctggccttacagaaagagtcaagaaaggttcccttctcttcaagtttttgaaagagtttgagaagtagtggtatta

SEQ ID NO: 80675 - DNA, 601 bp, Human
gatacattttttcatttctgcaaaaatgtccttgggattttgatagagattacattgaatgtatagatcactttaggaaatgttgacataattagtcttataattcataatcatggcatatctttccatttatttttgtattctttaattactttcagtaatgttttatagttttcattgtactagtcttccacctccttggtgagtttactcctattttattatttttgatactattgtaaatggattttttcctaatttctttttttgaattgttcattggtagtgtatagaaatgcarttgacttttccagttgattttgtattccgcttctttgatgaattcattttagtactactaaataaaaattaaaaacacagtttagatataccccacggcaattacccataaccatgtagccaaaacttaagacatcctgatatccctgaaacattagctataatcataaaaaatcccacaaaatataagttttacaccttcatcatgacataatatggttcagtgaagttaaatcaagcagctatagaaaaatcagcttaaacagctctgattgcctttaaaaagaatataaatttataa

SEQ ID NO: 80676 - DNA, 601 bp, Human
tgtccaacttgagtttcttccactttttggctattgtgaataatactgctataaacgtgggtgtacaaatatctgtttgaaaccatgctttcaattcttttggacgtatacctagaagtgggaatgatggatcatctgctaatcctgtttttacttttgaggaactatcatactgttttccatagtggctgcaccattttacattcccattaacagggcacgagggttccaacttctctacaaatttgctaatgcttattgtgtgtgtgtgttgtttttgttttttgagacagagtctcgytctgtcgcccaggctggagtgcagtggtgccatctcagctcactgcaagctccgcctcctgggttcacgccattctcctgcctcatcctcccaagtagctgggactacaggcgcctgccaccacgccgggctaatttttttgtattttttttttagtggagacggggtctcaccatgttagccaggatggtctcaatctcctgacctcgtgatccgcctgccttggcctcccaaagtgtggggattacaggcgtgagccaccgcacccggcctgtgtgtgttttttataatagtcatcct

SEQ ID NO: 80677 - DNA, 601 bp, Human
cattttaattgtgtattggctttttttttttcagatggattttcactcttgttgcccaggctggagtgccatggcacaatctcggctcaccacaacctctgcctcccaggttcaagcgattctcctgcctcagcttcccgagtagctgggactacaggcatgcatcacaatgcccagctaattttgtattattagtagagatggggtttctccgtgttggttagggtgatcttgaactcccaatctcaggtgatctgctcgcttcaccctcccaaagtgctgggattacaggtgtgagccrccgtgcccagcttgtgcattggctttttaaatcaacaatatttccattttatgtgtaattgttatagtgactaaaataaatgctgtttttttaaatctaaaactaaggtaaattatatataacatgaaacttatcttttaatcttttaaaatacatagttcagtgacactacatttattaatgttgttgtgcaataatcacaactatccatcctcagaagttatttcatcttcccattcttccctccttacaaccgctggcatccaacattctactgttggtttttatgaatttgactac

SEQ ID NO: 80678 - DNA, 601 bp, Human
agggcaggagtttgagaccagcctgaccaacatggtgaaaccctgtctctactaaaaatacaaaaattagccgggcatggtggggcatgcctgtaatcccagctactcaggaggctgaggcaggaggatcccttgaaccagggaggtggaggttacaatgagccgagattgtgccactgcattctagcctgggcaacagagcaagactccatctcaaaaaaaaaaaaaaagagaaccatattaatagcttcccacaagttttgatgcattaaaccttcattatattttgaaatatttttgwattagcttttaatttctcctttgaaccatggattatttataagtgtgttgcttagcatccaaatttggaggtctttctagacattgttatctatttccaattgaatttcattgagatcagagaacatatatgagttctcttttttaaaagagactttacttagacttattttatagcccagaatatgggctataaaatgagtgagggtaccatcttcactagaagagaatgagttttcagtagatgcatgtgtcctcttataaatgtcaattaagtcaaggtggttcagatcttttatga

SEQ ID NO: 80679 - DNA, 601 bp, Human
ataataagtagatttactttgttttttcaggacttgtttttgcctgataagactcaggaattatgaaatgtgaagttaagtgtggctcacgcctgtaatcccagcattttgggaggccgaggcgggcgatcatttgagggcaggagtttgagaccagcctgaccaacatggtgaaaccctgtctctactaaaaatacaaaaattagccgggcatggtggggcatgcctgtaatcccagctactcaggaggctgaggcaggaggatcccttgaaccagggaggtggaggttacaatgagccragattgtgccactgcattctagcctgggcaacagagcaagactccatctcaaaaaaaaaaaaaaagagaaccatattaatagcttcccacaagttttgatgcattaaaccttcattatattttgaaatatttttgaattagcttttaatttctcctttgaaccatggattatttataagtgtgttgcttagcatccaaatttggaggtctttctagacattgttatctatttccaattgaatttcattgagatcagagaacatatatgagttctcttttttaaaagagactttacttaga

SEQ ID NO: 80680 - DNA, 601 bp, Human
taaaactataaatacgatattaccttaatgcccaactttgtattatctgccctactataataagtagatttactttgttttttcaggacttgtttttgcctgataagactcaggaattatgaaatgtgaagttaagtgtggctcacgcctgtaatcccagcattttgggaggccgaggcgggcgatcatttgagggcaggagtttgagaccagcctgaccaacatggtgaaaccctgtctctactaaaaatacaaaaattagccgggcatggtggggcatgcctgtaatcccagctactcrggaggctgaggcaggaggatcccttgaaccagggaggtggaggttacaatgagccgagattgtgccactgcattctagcctgggcaacagagcaagactccatctcaaaaaaaaaaaaaaagagaaccatattaatagcttcccacaagttttgatgcattaaaccttcattatattttgaaatatttttgaattagcttttaatttctcctttgaaccatggattatttataagtgtgttgcttagcatccaaatttggaggtctttctagacattgttatctatttccaattgaattt

SEQ ID NO: 80681 - DNA, 601 bp, Human
ctttaaaactataaatacgatattaccttaatgcccaactttgtattatctgccctactataataagtagatttactttgttttttcaggacttgtttttgcctgataagactcaggaattatgaaatgtgaagttaagtgtggctcacgcctgtaatcccagcattttgggaggccgaggcgggcgatcatttgagggcaggagtttgagaccagcctgaccaacatggtgaaaccctgtctctactaaaaatacaaaaattagccgggcatggtggggcatgcctgtaatcccagctaytcaggaggctgaggcaggaggatcccttgaaccagggaggtggaggttacaatgagccgagattgtgccactgcattctagcctgggcaacagagcaagactccatctcaaaaaaaaaaaaaaagagaaccatattaatagcttcccacaagttttgatgcattaaaccttcattatattttgaaatatttttgaattagcttttaatttctcctttgaaccatggattatttataagtgtgttgcttagcatccaaatttggaggtctttctagacattgttatctatttccaattgaa

SEQ ID NO: 80682 - DNA, 601 bp, Human
gctttaaaactataaatacgatattaccttaatgcccaactttgtattatctgccctactataataagtagatttactttgttttttcaggacttgtttttgcctgataagactcaggaattatgaaatgtgaagttaagtgtggctcacgcctgtaatcccagcattttgggaggccgaggcgggcgatcatttgagggcaggagtttgagaccagcctgaccaacatggtgaaaccctgtctctactaaaaatacaaaaattagccgggcatggtggggcatgcctgtaatcccagctrctcaggaggctgaggcaggaggatcccttgaaccagggaggtggaggttacaatgagccgagattgtgccactgcattctagcctgggcaacagagcaagactccatctcaaaaaaaaaaaaaaagagaaccatattaatagcttcccacaagttttgatgcattaaaccttcattatattttgaaatatttttgaattagcttttaatttctcctttgaaccatggattatttataagtgtgttgcttagcatccaaatttggaggtctttctagacattgttatctatttccaattga

SEQ ID NO: 80683 - DNA, 601 bp, Human
attaaacaagttttattgggggttttgaagaaactccccaggcctccacaaacaagggtattggaggtttgaaggaactccccaaacctccatggtttagcagggtaatcaccccagcacctggacccatttagattaagtaaatttactgaggctccacaggaaggtcttcaggactcagaccttagttacagattaaaagaagttaatcacttatgtctttagatgaatgcacacttacatgtagacatataggttagaaaggatataagctctgaaacactttgtaattttgagttgstctggcgataatttccaggccttctccctgtaaccagctacagaaataaaaactctttcttcccagttcattggcatctcattaatgggtggcaagaaatagcagcccgaccctcagtttggtccaggaacagtatggttgttcctcaaaaaattaaaagtagaattaccagatgatccagcaatcccacttctgggtatgtatccaaaagaactgaaagcagagttttcatgtttataatttcactgaagcacatatatactgtccttatagagtcatcagctttaaaactataaatac

SEQ ID NO: 80684 - DNA, 601 bp, Human
tacaaaggctggaatgtaacaaaagcccatcaagagttttgcttaggcctttcctgggccttaaagcatgacaaaataatggaggaattcataacaggacccatttaggattaaacaagttttattgggggttttgaagaaactccccaggcctccacaaacaagggtattggaggtttgaaggaactccccaaacctccatggtttagcagggtaatcaccccagcacctggacccatttagattaagtaaatttactgaggctccacaggaaggtcttcaggactcagaccttagttayagattaaaagaagttaatcacttatgtctttagatgaatgcacacttacatgtagacatataggttagaaaggatataagctctgaaacactttgtaattttgagttggtctggcgataatttccaggccttctccctgtaaccagctacagaaataaaaactctttcttcccagttcattggcatctcattaatgggtggcaagaaatagcagcccgaccctcagtttggtccaggaacagtatggttgttcctcaaaaaattaaaagtagaattaccagatgatccagcaatcccact

SEQ ID NO: 80685 - DNA, 601 bp, Human
agcaggcactctctctaagcccctaaaatagacagtgctaccgggaacaaatcaacctcctccactccagtactgcatttggtgccccataacaatgaccctctctcagctgaaagtagccagaaagattatgacaccccatctccctacgattctcatgataaataaatacacaagcatgatagaaatcatgcgcaaattgacagtggggattgtagcaggccaggtttcactaatgcaggcctccatcacaactgtttcagtactaatcaagtgcttaagttaactattaaatgctttaaaaaaaaaaaaaaaaaagccagtgcccttatacaaaggctggaatgtaacaaaagcccatcaagagttttgcttaggcctttcctgggccttaaagcatgacaaaataatggaggaattcataacaggacccatttaggattaaacaagttttattgggggttttgaagaaactccccaggcctccacaaacaagggtattggaggtttgaaggaactccccaaacctccatggtttagcagggtaatcaccccagcacctggacccatttagattaagtaaatttactgaggctccaca

SEQ ID NO: 80686 - DNA, 601 bp, Human
ttcagcaggcactctctctaagcccctaaaatagacagtgctaccgggaacaaatcaacctcctccactccagtactgcatttggtgccccataacaatgaccctctctcagctgaaagtagccagaaagattatgacaccccatctccctacgattctcatgataaataaatacacaagcatgatagaaatcatgcgcaaattgacagtggggattgtagcaggccaggtttcactaatgcaggcctccatcacaactgtttcagtactaatcaagtgcttaagttaactattaaatgctttaaaaaaaaaaaaaaaaaagccagtgcccttatacaaaggctggaatgtaacaaaagcccatcaagagttttgcttaggcctttcctgggccttaaagcatgacaaaataatggaggaattcataacaggacccatttaggattaaacaagttttattgggggttttgaagaaactccccaggcctccacaaacaagggtattggaggtttgaaggaactccccaaacctccatggtttagcagggtaatcaccccagcacctggacccatttagattaagtaaatttactgaggctcc

SEQ ID NO: 80687 - DNA, 601 bp, Human
ctcataatttgtgtacatagaccctgtacagggtttctgacctgtggtaagtaaagaatgtcactttctgacaggccaggaaccccaacttatcttggaacctcaagaagagaggaattcacccaactcataggtatttgatggtataaatccatggttgggctcggctttaaaaaggtcttatctcagattcctgctatggaacaaagttccatcaaagcccatttaaaacgcctatgtaaaaaataattattcttgctgcacggtatataagtaattaggccaagtataataaagcaawccagtcctaccatgatttgtcttttaataaaaatgggaaacaagagagaaaaattatgtttcaaaaattatagttacacctgttaaattctagtcttcctcgatgtttttcagtttttattattttctacagtttggattaaattctaatttttctggctgcaagtctcaaaatgttttcaattttttcctttttcttttcctttttctccattttccctaactggaaatcactgaaacctaagctttgctttcttaaagccctgtgaactgaaaactaggtgtttcagcaggcactctc

SEQ ID NO: 80688 - DNA, 601 bp, Human
ttctctctacctgattttctccagaatttcgaaactgtgagtattcttaagttatggcaatatagttatttgcataagtgcagtaagaatctgttttcttttgtaacaggacacaattggaaaaactggttattttaccaaggctttgactttgctctcctttaaggaatcaaacttgacttaggaagccaagaaagcccttggaaactggcctcataatttgtgtacatagaccctgtacagggtttctgacctgtggtaagtaaagaatgtcactttctgacaggccaggaaccccaasttatcttggaacctcaagaagagaggaattcacccaactcataggtatttgatggtataaatccatggttgggctcggctttaaaaaggtcttatctcagattcctgctatggaacaaagttccatcaaagcccatttaaaacgcctatgtaaaaaataattattcttgctgcacggtatataagtaattaggccaagtataataaagcaatccagtcctaccatgatttgtcttttaataaaaatgggaaacaagagagaaaaattatgtttcaaaaattatagttacacctgttaaat

SEQ ID NO: 80689 - DNA, 601 bp, Human
atacctagtatataattaaaatcccaaatttaccaaggttttcaccaaaagaaaaggttgctaagaattaacaatgtaatgtgtatttaagactattgaaaaaacagtttacatgcaagttgtgtaaggaaagtaaaatatacttttggtaaaaagattataaggaggcatgagaatgtggatattttttactagattaaaaggttaaaggattgttttaagttggataaaatgaaagtttaagcaagctgtggaagggtaattgtaaagacaattctgtgtgtaaatgtattggctaaarttaaagggatatcatccagtttttctgtaaattgagcattaaaataaaagcacaatgggtttctcttagagcactaaccttctgtttaacaaaaattgtaaagagttatgaaaggtctataaaactcttactttatggtcaaacattaaaattgggtaaatgtgtctataaggttttattaaaaattggatttaacattaatagtacactaatgtaaaggtgaaatgtggcttatttgatataaaattatacaggaagcattgtcaaacatgaaatggtgtttggctttctttgggctgt

SEQ ID NO: 80690 - DNA, 601 bp, Human
cttctggccttaagcagtctagtccacagacatgaaggaagtttgttctgggaaaggactgttatcacatttgtttcaaagctaaattataaactaagttaataaacaagaataccttgtaggttagaaggaagatggagtcagttaggtcagatcattttcactgtctcggtcataattttgcaatggtggtttcctaactttaatgacaactatcgcagttttcatatataatctgggtaaatgattaaaataaataattagataaatgtaatgggatacatactcataagtaaacttstcataatttagaatctaaagttatattaaacaacagatatctaattatttgggtattttctaataaaaatatatcgtaggaaaacattctttctaaagattgtgtcctttttaaagggtaacttttttttttttttttttttttgagacagagtcttgctctgtcacccaggctggagtgcagtggcacaattactgctcactgcaagctccacctcccaggttcacaccattctcctgcctcagcctcccgagtaggtgggactacaggtgcccaccaccacgcctggctaattttttg

SEQ ID NO: 80691 - DNA, 601 bp, Human
taattctccctttttgaaaacccaggattcagtatgggctccacccagagctcaaacatccagttaaggccgggcgtggtatctcatgcctgtaatcctagcactttggaaggccgaggcgggctgatcacttgaagtcaggagttcgagaccagcctggccaacatggtgaaaccccatctctaagaaaaatacaaaaattaaccaggcatggtggcaggcacctgtaatcccagctacttgggaggctgaggcacgagaattgctttaacctgggaggcagaggttgtagtgagcagasatcatgccactgtactctggcctaggcagtagagggagactgaaaaatgaggtcttatgaatctataaaatgtatttctgttggcatgcataatacacttatgtatttgtcttgtgtacaccatgtttcactactgaagatatacaaaagaggtctaattaaatggctcaaagaaaaataaaagcacttgaataacagaaaaaaggaaagactagtcaaatgctttttcaagtttatgtgacttaaaatctttaataagtaagctggttttaaaaattattggtaaagtaatattagaaa

SEQ ID NO: 80692 - DNA, 601 bp, Human
tgtaaaagcatcacatggtctagcctcataataattctccctttttgaaaacccaggattcagtatgggctccacccagagctcaaacatccagttaaggccgggcgtggtatctcatgcctgtaatcctagcactttggaaggccgaggcgggctgatcacttgaagtcaggagttcgagaccagcctggccaacatggtgaaaccccatctctaagaaaaatacaaaaattaaccaggcatggtggcaggcacctgtaatcccagctacttgggaggctgaggcacgagaattgctttwacctgggaggcagaggttgtagtgagcagacatcatgccactgtactctggcctaggcagtagagggagactgaaaaatgaggtcttatgaatctataaaatgtatttctgttggcatgcataatacacttatgtatttgtcttgtgtacaccatgtttcactactgaagatatacaaaagaggtctaattaaatggctcaaagaaaaataaaagcacttgaataacagaaaaaaggaaagactagtcaaatgctttttcaagtttatgtgacttaaaatctttaataagtaagctggtt

SEQ ID NO: 80693 - DNA, 601 bp, Human
tttgggaaaaaattgtttaagtgcactgtaaaagcatcacatggtctagcctcataataattctccctttttgaaaacccaggattcagtatgggctccacccagagctcaaacatccagttaaggccgggcgtggtatctcatgcctgtaatcctagcactttggaaggccgaggcgggctgatcacttgaagtcaggagttcgagaccagcctggccaacatggtgaaaccccatctctaagaaaaatacaaaaattaaccaggcatggtggcaggcacctgtaatcccagctacttgrgaggctgaggcacgagaattgctttaacctgggaggcagaggttgtagtgagcagacatcatgccactgtactctggcctaggcagtagagggagactgaaaaatgaggtcttatgaatctataaaatgtatttctgttggcatgcataatacacttatgtatttgtcttgtgtacaccatgtttcactactgaagatatacaaaagaggtctaattaaatggctcaaagaaaaataaaagcacttgaataacagaaaaaaggaaagactagtcaaatgctttttcaagtttatgtgact

SEQ ID NO: 80694 - DNA, 601 bp, Human
ctctctctcctagggccttatctttttgagcaaaactttttttcttctcagttgactgaattctgttttcttcattaatagctattaaacagaagctactctggggttttaaagaaaaagtgtaatttagacacttagaaatgtctttgggaaaaaattgtttaagtgcactgtaaaagcatcacatggtctagcctcataataattctccctttttgaaaacccaggattcagtatgggctccacccagagctcaaacatccagttaaggccgggcgtggtatctcatgcctgtaatccyagcactttggaaggccgaggcgggctgatcacttgaagtcaggagttcgagaccagcctggccaacatggtgaaaccccatctctaagaaaaatacaaaaattaaccaggcatggtggcaggcacctgtaatcccagctacttgggaggctgaggcacgagaattgctttaacctgggaggcagaggttgtagtgagcagacatcatgccactgtactctggcctaggcagtagagggagactgaaaaatgaggtcttatgaatctataaaatgtatttctgttggcatgcataatacac

SEQ ID NO: 80695 - DNA, 601 bp, Human
gtgtttttggttttatttctctctctcctagggccttatctttttgagcaaaactttttttcttctcagttgactgaattctgttttcttcattaatagctattaaacagaagctactctggggttttaaagaaaaagtgtaatttagacacttagaaatgtctttgggaaaaaattgtttaagtgcactgtaaaagcatcacatggtctagcctcataataattctccctttttgaaaacccaggattcagtatgggctccacccagagctcaaacatccagttaaggccgggcgtggtrtctcatgcctgtaatcctagcactttggaaggccgaggcgggctgatcacttgaagtcaggagttcgagaccagcctggccaacatggtgaaaccccatctctaagaaaaatacaaaaattaaccaggcatggtggcaggcacctgtaatcccagctacttgggaggctgaggcacgagaattgctttaacctgggaggcagaggttgtagtgagcagacatcatgccactgtactctggcctaggcagtagagggagactgaaaaatgaggtcttatgaatctataaaatgtatttctg

SEQ ID NO: 80696 - DNA, 601 bp, Human
gaaattgaaaacaacgaggctgggcacggtggctcatgcctgaatcccagcactttgggaggccaaggtagggtgtggatcacctgaggtcaggagttcgagaccagcctggccaacatggtgaaaccctgtttctattaaaaatacaaaaattagctgggcgtggtggtgggcatctgtaatcccagctactcaggaggctaaggcaggagaatcacttgaacccgggaggcggaggttgcagtgagctgagatggcaccattgcacgacagcctgggcaacaaaagtgaaatttttgtstcaaaaaaaaaaaaaaaaaaacaactgaactcagaagcagagaatagaatggtggttactagagtctgggcacgggggaatggggagatgataatcaaaggtacaaaccattggttagacaggaggaataagatttttgagatctgttgcacagtgcaatgaatgtagttaataacagcatattgtacatttcaaaattgctaaaagaataaatttcaaatgttctcaccataaaaatgttaagtatttgaggtgttggacatattagctgatttaattattccatattgtattcataaa

SEQ ID NO: 80697 - DNA, 601 bp, Human
agccaagttatgcaatcaacctgtgtccaccaacagataaatggataaagaaaatgtggtatgtagacaatacagaatactattcagcctttaaaaagatagaaattttgtcacttgaaacaacatggatggaattggaatacatcatgctaagtgaaataagtgaggcacaaaaagagaaatactgtatgttttcatacatgaaattgaaaacaacgaggctgggcacggtggctcatgcctgaatcccagcactttgggaggccaaggtagggtgtggatcacctgaggtcaggagttygagaccagcctggccaacatggtgaaaccctgtttctattaaaaatacaaaaattagctgggcgtggtggtgggcatctgtaatcccagctactcaggaggctaaggcaggagaatcacttgaacccgggaggcggaggttgcagtgagctgagatggcaccattgcacgacagcctgggcaacaaaagtgaaatttttgtgtcaaaaaaaaaaaaaaaaaaacaactgaactcagaagcagagaatagaatggtggttactagagtctgggcacgggggaatggggagatgataatcaa

SEQ ID NO: 80698 - DNA, 601 bp, Human
ttaaatatatgaccttaaactattaaactgctagaagaaaacacaggggctaaaactacacaacatttatctgggcaacattttttaaaatttgacccctaaagtgcaaaaaacaaaagcaaaaatagacaaatggaattatatcaacataagaagtttctgcggaacctgaggtcgggagttcaagaccagcctgatcaacatggagaaaccccatctctactaaaaatacaaaattagctgggcatggtggcatgcaccgataatcccagctactcaggaggctgaggcaggagaatcrcttgaacccaggaggtggaggttgccgtgagtcaagatcatgccattacactccagcctaggcaacaagagtgaaatttcatctcaaaaaaaaaaaaaaaaaagtttctgcacaacaaaggaaacaacagagtgaagcaataagctacagactgggagaaaatatttgcataccatacatctgataaggggttaatatctaaaatatataaggaactcaaataattctattcaaagagaaaaaataatctgattacaaaatgggcaagggacctgagtagacatttctcagtagaagaca

SEQ ID NO: 80699 - DNA, 601 bp, Human
caccatatacaaaaatcaactcaaaatggattaaagacttaaatatatgaccttaaactattaaactgctagaagaaaacacaggggctaaaactacacaacatttatctgggcaacattttttaaaatttgacccctaaagtgcaaaaaacaaaagcaaaaatagacaaatggaattatatcaacataagaagtttctgcggaacctgaggtcgggagttcaagaccagcctgatcaacatggagaaaccccatctctactaaaaatacaaaattagctgggcatggtggcatgcaccgrtaatcccagctactcaggaggctgaggcaggagaatcgcttgaacccaggaggtggaggttgccgtgagtcaagatcatgccattacactccagcctaggcaacaagagtgaaatttcatctcaaaaaaaaaaaaaaaaaagtttctgcacaacaaaggaaacaacagagtgaagcaataagctacagactgggagaaaatatttgcataccatacatctgataaggggttaatatctaaaatatataaggaactcaaataattctattcaaagagaaaaaataatctgattacaaaatg

SEQ ID NO: 80700 - DNA, 601 bp, Human
ctattaagagcaatgacaaaaaaaaattagtaaatttaactaaggaagtgaaagacttgtatgttaaaaaccgtaaaacactaatgaacaaaacagaagagacaaataaaacggaaagagacacaaatgcatgaaaataaatgttcatgacttggaagaactaatattgttaaaatgtccatactatccaaagcaatctataggctcaatgtaatcactatcaaaattccaatatcatttttcatagaaatagagaaaacaatcctaaaattcatatgcaaccataaaaaaaaaaaaaaaccacaaatagccaaggcaatcatgatcaaaaagtacaatgctggaggcatcacactacctgatttcaaactatactacaaagcaataataattaaaacagcatggcacgggtataaaaatggacatattgaccaatggaacaaaatacagagcctataaatgaatccacatagctatggtcaattgatttttgccaaaagtgccaagaatacacagtgggaaaaaaaagtctccacaataaatggtgttaggaaagctggatatccatatgcacaagaatgaaactggacccttatcttac

SEQ ID NO: 80701 - DNA, 601 bp, Human
cctattaagagcaatgacaaaaaaaaattagtaaatttaactaaggaagtgaaagacttgtatgttaaaaaccgtaaaacactaatgaacaaaacagaagagacaaataaaacggaaagagacacaaatgcatgaaaataaatgttcatgacttggaagaactaatattgttaaaatgtccatactatccaaagcaatctataggctcaatgtaatcactatcaaaattccaatatcatttttcatagaaatagagaaaacaatcctaaaattcatatgcaaccataaaaaaaaaaaaaamacacaaatagccaaggcaatcatgatcaaaaagtacaatgctggaggcatcacactacctgatttcaaactatactacaaagcaataataattaaaacagcatggcacgggtataaaaatggacatattgaccaatggaacaaaatacagagcctataaatgaatccacatagctatggtcaattgatttttgccaaaagtgccaagaatacacagtgggaaaaaaaagtctccacaataaatggtgttaggaaagctggatatccatatgcacaagaatgaaactggacccttatctta

SEQ ID NO: 80702 - DNA, 601 bp, Human
gcaattaggcaagaaaaagaaaagaattattaggtattcaaatagaaaaggaagaagtaaaattgtctatttgccgatgacatgatcttctgtatagaaaaccctgaagactccaccaaaaaactgttagaaatttgtaaacaaattcagtaaggttgtgggatacaaaatcaacatatgaaaatcagtagcatttctatatattaataatgaactatatgaaacagacattaagaaaacaaacctattaagagcaatgacaaaaaaaaattagtaaatttaactaaggaagtgaaagacytgtatgttaaaaaccgtaaaacactaatgaacaaaacagaagagacaaataaaacggaaagagacacaaatgcatgaaaataaatgttcatgacttggaagaactaatattgttaaaatgtccatactatccaaagcaatctataggctcaatgtaatcactatcaaaattccaatatcatttttcatagaaatagagaaaacaatcctaaaattcatatgcaaccataaaaaaaaaaaaaaaacacaaatagccaaggcaatcatgatcaaaaagtacaatgctggaggcatcacacta

SEQ ID NO: 80703 - DNA, 601 bp, Human
aaattaggtgtaaagggaatgtatcaacacaaaaaaagccttatatgacaagcttacagctaatatcatactcagcagtgaaaagctgaaagcttttcctttaatatcaggaacaacacaaggatgctcactctcaccacctcttttcaacatggtactggaagtcctagccagagcaattaggcaagaaaaagaaaagaattattaggtattcaaatagaaaaggaagaagtaaaattgtctatttgccgatgacatgatcttctgtatagaaaaccctgaagactccaccaaaaaactgttagaaatttgtaaacaaattcagtaaggttgtgggatacaaaatcaacatatgaaaatcagtagcatttctatatattaataatgaactatatgaaacagacattaagaaaacaaacctattaagagcaatgacaaaaaaaaattagtaaatttaactaaggaagtgaaagacttgtatgttaaaaaccgtaaaacactaatgaacaaaacagaagagacaaataaaacggaaagagacacaaatgcatgaaaataaatgttcatgacttggaagaactaatattgttaaaatgtccat

SEQ ID NO: 80704 - DNA, 601 bp, Human
actaagaaaaaagaaagaagacaaataaattaaatcaaaaatgaatgaggaggccaggtgcagtggctcatgcctataatcccagcattttgggaggccgagacggatggatcacttgaggccaggagttggagaccagcctggccaacatggcaaaacctcgtccctaataaaatacaaaaaaaaaaaaaaaaaaaaaagccaggcatggaggtgtgcatctgtaatcccagctacttgggtggctggggcacaaaaatcgcttgaacctgggaggtgaaagtggcagtaagctgagatygtcacactgcactccagcctgggcaacagagggagactctgtctcaaataaaaaaaaaaatgagacacattacaatgcataccacagaaatgcaaaggatcatatgaaaatattatgaacaattatatgccaaaggattgaaccacccggaagaaatggataaatttctagacacatacaacctaccaatactgaatcatgaagaaatggaaaatccgaacagaccaataatgattaaggatattgaatcagtaatgaaaagtctcctatcaaagaaacacccaggacccagaaggcttc

SEQ ID NO: 80705 - DNA, 601 bp, Human
tgaaaaaataaatgaaatcactaaactttaactagactaactaagaaaaaagaaagaagacaaataaattaaatcaaaaatgaatgaggaggccaggtgcagtggctcatgcctataatcccagcattttgggaggccgagacggatggatcacttgaggccaggagttggagaccagcctggccaacatggcaaaacctcgtccctaataaaatacaaaaaaaaaaaaaaaaaaaaaagccaggcatggaggtgtgcatctgtaatcccagctacttgggtggctggggcacaaaaatcrcttgaacctgggaggtgaaagtggcagtaagctgagatcgtcacactgcactccagcctgggcaacagagggagactctgtctcaaataaaaaaaaaaatgagacacattacaatgcataccacagaaatgcaaaggatcatatgaaaatattatgaacaattatatgccaaaggattgaaccacccggaagaaatggataaatttctagacacatacaacctaccaatactgaatcatgaagaaatggaaaatccgaacagaccaataatgattaaggatattgaatcagtaatgaaaa

SEQ ID NO: 80706 - DNA, 601 bp, Human
tctgatttaaaaggtgcctgacatatagaccagagagcccagaaatgaacttgcacgtacaaccatgtattgctcaacattgttctgagcaaagggtcattaggcaattgtgttgtgtgaacatcagaagagtgtgcttacacaaacctagatggtgtatcctatgacacacctggcctatatggtatagccttttgctcctaggctacaaacctgtgtagcatgttacataattgcatggagccaccatcacatatgcagtctgttgttgacagaaatgttgttatgtggtgcatgactrtatatgatcaagtaatttttggcaaaggtatcaagaccatttaattgagaggacaatctttttaaaaatggtcttgggaaatctagacattgactcatcacaaaacaatgacctcggacctttaacttacacgtatacaaaaattaactcaaaatggatccaaaatctaacataaaagtgaaaaccctaaaacttagaagaaaacataggaactattcttcctgaccttggatttggcaatgatttcttgaatgtgatccccaaaacacaagcaatataggaaaaaaagtagataaattg

SEQ ID NO: 80707 - DNA, 601 bp, Human
tgtttgtttgtcccttcatatttcagggaaggccaagtaacatacacttgcaaaactcttctaaacatgttcattccagaaaatgtgggcaaggaaagtttttacaagaatacacagaccacacgtgatattctcagctaaagatagcatccattaatattttgtctcatttagttccactatttttccataggtatgcctattctctctttctctctttctcttattctctctcacacagacatacacacagacacacatttttataaatgggggttataatatagcaaacttaaaaaaytgggatacaggatcaaacattaaatagtgaacttctgatttaaaaggtgcctgacatatagaccagagagcccagaaatgaacttgcacgtacaaccatgtattgctcaacattgttctgagcaaagggtcattaggcaattgtgttgtgtgaacatcagaagagtgtgcttacacaaacctagatggtgtatcctatgacacacctggcctatatggtatagccttttgctcctaggctacaaacctgtgtagcatgttacataattgcatggagccaccatcacatatgcagtctgtt

SEQ ID NO: 80708 - DNA, 601 bp, Human
accaggtggacacaatccctctgaggggctggacctcttttgttgtggggccgctctctgctggggagctaggtcttgttgggtgatcagagcagactcagctgagacctgtggggacaaagcagggatgggcatgagtggcttccagacctcacccctcccaggatccactcacattctcttgagcccaggcacccaagctaaacagaaccctcatctttcttgcagctctcacctctcaaacatcctttagtgtttgtttgtcccttcatatttcagggaaggccaagtaacatacacytgcaaaactcttctaaacatgttcattccagaaaatgtgggcaaggaaagtttttacaagaatacacagaccacacgtgatattctcagctaaagatagcatccattaatattttgtctcatttagttccactatttttccataggtatgcctattctctctttctctctttctcttattctctctcacacagacatacacacagacacacatttttataaatgggggttataatatagcaaacttaaaaaattgggatacaggatcaaacattaaatagtgaacttctgatttaaaagg

SEQ ID NO: 80709 - DNA, 601 bp, Human
cctcccgggttcaagcgattctcctgcctcagcctcccaagtagctgggactacaggcacgccactatacccagctaatgtttgtatttttagtagaaacagggtttcgccatgttggtcaggctggtgtcaaactcctggcctcaagtgatttgcccaccttggcctctcgaagtgctgggattacaggtgtgagtcactgcgcccggcgttatatgggaatttttattagaattttggacccagcgcagtggctcacgcctgtaatcccaacactttggaaggccgaggtgagaggatygcttgagcccaagtggttgaggctacagtgagctatgatcctgccaccgcactccagcctgggcaacagagtgaaatcctatctcaatcagtcaatcaatcaatcaatcaatgtataatttccctaatctgtaagaattcatgtgactcaatgatttaaaaaaaaaaaaaaaaaaaacctaacctcttactaggagtgaagaaaacctaggagaaccagtgtacaaacagtgtctgtgtcatgaacagattcttgacctcattcacaggaagagaaatgcacatttcgaggagtttccac

SEQ ID NO: 80710 - DNA, 601 bp, Human
atcatggagggggcagcatttttactggaagagaagcttattttgcacatagacttgccttccctgcatgcaatgcttctgtcaaaactatcctctgtggactcacagaatgccttatccacagtcatggtattcacacagcattgcttctgattgagggactcacttgatggcaaatgaagcgcccactataatgggcctgtgctcatggaattactggtcttaccatgttccccaccatctcaaaactgctggcttggtaagatggtgggatatggctttttgaaaactcatttacaaygtcagctgggtggcagtaccttgaagggctgcaacaaggttctccaggagactgtctatgctctgaattatcctccaatacatgcggttgcttcttccattgctaggattcatgtgtccaggaatctaggggtggaagcaggaatggccccactccacattacccttagtggcctgttatcaaaatttttgctgctttatgctttgctagagctctgagtttcagagggaggaatgattccatgaggagacacaacagtgattctgtgtaacttgaagactgccacttggccactttggg

SEQ ID NO: 80711 - DNA, 601 bp, Human
ctgtggtcaatgatttggctggagggtcagaggctctgaaggaaaactgataacaaggaagtctggggaagaggtgtgtggatagacctttctcaatgggtaaaaaaaccatgaagatatttgtgccccatgtgacacaaatatcttcacaaaaagtgatcttagcagggaaggattttaataatcaggtggataggatgacctgttctgtggctaccagtcagcttctttcccagccatccttgtcatcactcaatgggctcatgaacaaagtgtgcatggtggcagggatggaggttaygtatgggcttaacaatacagacttccctcaccaaggccaacctggctacagctgctactgagtgcccaatctataggcagcagagtccaacactgagtctctgatatagcaccattcagagggtcagtctgccagctacctggtggcaggttgattattacactgaaccatttctatcatggagggggcagcatttttactggaagagaagcttattttgcacatagacttgccttccctgcatgcaatgcttctgtcaaaactatcctctgtggactcacagaatgccttatccacagt

SEQ ID NO: 80712 - DNA, 601 bp, Human
agtgtgcttattttgattttggtggcaacatattcctcatttgggtgtgtttctctggcctatttatcaagtcacctaaaaatgtgctagttttgagtggtgctcagaacaagaaaaggctctgcaacaggtccaggctgccgtagacatttttctgtcacttgggccatacgacccagcagacccaacggtgcttgaagtattggtggcagacagcaatgctgttttgaacctttagtagcccactctaggtcaaccacagcacaggcccttaggttttggagcaaagacttgccagatmactctgcagataactactctccttttgagaaacagctcttggcttgtttctgggccttagtgcagactgaatggttaaccataggccaccaaattactctacgacctgactgctcatcgtgaactgagtgttattttgcctaccaagccataagtttgggcacatacagcctaaagtttccatttccattttcaaatgtaattggtatatatacaaaattgggcttaaataggccctgaaggcacaagaaagttacatgaagaagtggcccaagtgcccatgatccccactcctgcaata

SEQ ID NO: 80713 - DNA, 601 bp, Human
gaatttgatatccaggaacattatcattcaagaatgaagaagaaattaagaccttcttagataaatgaaaggtaatggagcacattactagtagatctgccctgtgaaatgctaaaaggaatcctttaggaggtaatgtaatgacattagataatagctcaaaggcatacgaagagataaagaacactggaggccgggtgcggtggctcacgcctgtaatcccagcactctgggaggccgaggcgggcggatcacgaggtcaggagatcgagaccatcctggctaacacggtgaaaccccrtctctactaaaaatacaaaaaaaaattagccgggcgaggtggcgggcgcctgtagtcccagctactcgggaggctgaggcaggagaatggcgtgaaacccaggggccggagcctgcagtgagccgagattacgccactgcactccagcctgggcgacagcgagactccgtctcaaaaaaaaaaaaaaaaaaagaaccctggaaaaggtaactatttaggtaaatataaatgctggtacgcagctacttaggctgctataataaaataccatagaccaagtggcttaaacaatagacattt

SEQ ID NO: 80714 - DNA, 601 bp, Human
cctgcaaccaagaatttgatatccaggaacattatcattcaagaatgaagaagaaattaagaccttcttagataaatgaaaggtaatggagcacattactagtagatctgccctgtgaaatgctaaaaggaatcctttaggaggtaatgtaatgacattagataatagctcaaaggcatacgaagagataaagaacactggaggccgggtgcggtggctcacgcctgtaatcccagcactctgggaggccgaggcgggcggatcacgaggtcaggagatcgagaccatcctggctaacacrgtgaaaccccatctctactaaaaatacaaaaaaaaattagccgggcgaggtggcgggcgcctgtagtcccagctactcgggaggctgaggcaggagaatggcgtgaaacccaggggccggagcctgcagtgagccgagattacgccactgcactccagcctgggcgacagcgagactccgtctcaaaaaaaaaaaaaaaaaaagaaccctggaaaaggtaactatttaggtaaatataaatgctggtacgcagctacttaggctgctataataaaataccatagaccaagtggcttaaac

SEQ ID NO: 80715 - DNA, 601 bp, Human
aggggagagagcctggccccaaagcagacctgtgccactgctgagatccagccctgtccacttggcctggctcatggccccacccccttgcagctgacagtttaaaagatttccttaccatgtagcatacattatacaaataatttctgtattattattattttaattaattattgagacagggttttgctctgttgcctgggctggaatgcagtggcacaatctcggctccctgcaacctcggcctcctgggctcaagagatccttctgcctcagcttcctaagtagctggaaatacagrcacgcgccaccatgcccggctaatgtttatatttttgtagagacggggtttctcatgttgcccaggatggtttcaaactcctgggctcaagtgatgcctcccaaagtgttgagattacaggcatgagccactgtgccgggcctgttttatttattaaaaagctcaaagacaaaatcatggaacatggtatgatgaagaccaaggtggaccagaatctaggtctcctgatcccattttagctacaacttttatgtcatcaccccgcattccacctttaggcatggggtccatatgttctgt

SEQ ID NO: 80716 - DNA, 601 bp, Human
accctgctactcagctcaactcagtttgccaaggagttctgagggccagtttctgcaccagcacactcatggctcattcaggatacccacccttcagctgtcactaacactcgttgagtcatacaaaaggaccacagttcattatttattacattagattaggggaaagcaccgtttaggggacaagcatcgtttagattgcatggccagtagcaagggaagtgcaagggatcacctgagagactgcaaggagaggagcccttgggggacttccccaaggcccagcctgctggggaggagrgagaggcctgagaacctgaagggtgagtgaggccgagcacctgccaggagcacagagcccaggggagagagcctggccccaaagcagacctgtgccactgctgagatccagccctgtccacttggcctggctcatggccccacccccttgcagctgacagtttaaaagatttccttaccatgtagcatacattatacaaataatttctgtattattattattttaattaattattgagacagggttttgctctgttgcctgggctggaatgcagtggcacaatctcggctccctgcaacc

SEQ ID NO: 80717 - DNA, 601 bp, Human
ttcccccaatcacagcaaatactaggggggccagagaagagcaaattactcttggcccctaaaacccaaatagggaaaagacaggtcttactgagggatcaggggccaggggtgaggccggctgggtgggctcaggtcctcatgggaacttgaaggagctccacccatggccttattatgccttttgtgggccatgggcacttttgtctttatgggcccctgcatgcataaaaatattaaaaaatacattttattgctgaattggtataaagatgaatatatgcctggctgcattctactyattcttcttatttcaagagaaattaaatcatttcatgggcccctaaaattatcatgggccccaagtcatggccttctgtggtcagtgaacaagtcagcctggtcaaggggactcgtgctggggaggggtggaaagaggctgctgcagggggcaggggtggtgacacgcagagggaccaggaggggcagccacaggctcaaggatgccccttgcgggtgctgtcaggggagagacaggggtacaaggagacttgggtcttttggggttccatggagctactgggagcccccggctcctgtc

SEQ ID NO: 80718 - DNA, 601 bp, Human
gcaactgtgactcctatgatgatgcctgagagagaacagggagaggcaggagtccctgggctggaggtcaccgtctcctccacagctggggcttccccactgtgctttgtacctgattctttgtggacacattcgatgtcactccagggtgtacaatcaccgaccttgaccatccctctgggacacctgggtacacacacggagggagaggggggactcttgatggaaagctggccaggtgggatgaaagaggagccaccctccctccccagtgtccctgagaaggtgtcaggggaaggayagtctcctcgtgtcagcagtgggtccccctgtgctcccttcttgaggctggggaagggtctgagcatgcgcacttcagcccctcggcctccctgctctggggtcagagctgcagttccaggagccttctgtgctgggcacacactgagcttccctgggctgcaggggaggcctgcgttaggagcaatcacactccaggggaaggtcacaagcccgtgtggccacaagatgagtccggtcttccagtcaaccacaaaagtgagctcttgtccccagctgtctgcccatttcccccaatcac

SEQ ID NO: 80719 - DNA, 601 bp, Human
tcacctgggctgcagcagggctcaccagcctatgtggtgctcaaaatggccatgtgtcccccacagtcagcccagagcgcccaggccacttcagagagtcagggcagccatgaggacaatgggaacccacccacccaggttctgctgtcccaggaagcagttcctgaacccctgagcccccagctcctggagaaatcaactcactctgtccacacgctcagggtccccaccaccacctaaaaaagaagcagtctccttagcaggaagggaggggcccatgaagcacccccctcccagaggwcagtggggcgcagggctgggctgggggctgggacactggacaaggagccctggggctggggacagaatggggccttacaactcagagacaccctgaggaagggggatgagaaggggaactagagtaaaaacaaacacttggaaaatctctggttctgctctgaccaaggctgaaaaaatcccacgaccacttctcatcctcacccttgtcacccagttgaggagccgactgccccctgcctggctgggcctgaagatgggaggaactggccctgccctcctggacttggctgggagatat

SEQ ID NO: 80720 - DNA, 601 bp, Human
ggctcgctgcagggtcctcagtatgcagctgcacctgacatccccaccccctctcagtgaggtcaccgcaggcagcccagactcagcacatccaggacccgctgctggggccaggcccccagtgctgtgctcaggcagacaccccatccctagggtgcaggctgtggggtgaggatgtcacctgggctgcagcagggctcaccagcctatgtggtgctcaaaatggccatgtgtcccccacagtcagcccagagcgcccaggccacttcagagagtcagggcagccatgaggacaatgggracccacccacccaggttctgctgtcccaggaagcagttcctgaacccctgagcccccagctcctggagaaatcaactcactctgtccacacgctcagggtccccaccaccacctaaaaaagaagcagtctccttagcaggaagggaggggcccatgaagcacccccctcccagaggacagtggggcgcagggctgggctgggggctgggacactggacaaggagccctggggctggggacagaatggggccttacaactcagagacaccctgaggaagggggatgagaaggggaactaga

SEQ ID NO: 80721 - DNA, 601 bp, Human
gcaggggttgcaatgagccaagatggtgccactgcactccagcccaggtgatagagcaagatcctgtctcaaaaaaaaaaatcttcaaagtcattaataagcatggaggaagtattggcattgttcatttgtttccttttaaaatctcttctctttatttaaaaagaaagtggtacagatgcaaggaagaaacagaaacagtctaggtggaagagatctctgcccatataaacatttgacattttcaaggataagatctagttttttttgtttgtttgtttttttaaaaaagagtgaagakgaagagagaaaaaagtaaacatttgacatgtagcaaaggaggtggcaaaagggcaaaggcaagggaaaaaggaagaattggttgctaaatgggcttggaagaaggaaacagagactcagaataattcagggagtttctcagcttatattgaatcaaaaattcaattctgtttagattatattgctgtatgttaaaaatcaaatcattaaaaataaaacactgcaggaaactggatagtctcatcttatgttcgagggaaggactttcagtgcttacgagcaatgaacaataaatgtatat

SEQ ID NO: 80722 - DNA, 601 bp, Human
tcaggaagctgaggtgagaggatgacatgagcccaggaggcaggggttgcaatgagccaagatggtgccactgcactccagcccaggtgatagagcaagatcctgtctcaaaaaaaaaaatcttcaaagtcattaataagcatggaggaagtattggcattgttcatttgtttccttttaaaatctcttctctttatttaaaaagaaagtggtacagatgcaaggaagaaacagaaacagtctaggtggaagagatctctgcccatataaacatttgacattttcaaggataagatctagttttttttgtttgtttgtttttttaaaaaagagtgaagaggaagagagaaaaaagtaaacatttgacatgtagcaaaggaggtggcaaaagggcaaaggcaagggaaaaaggaagaattggttgctaaatgggcttggaagaaggaaacagagactcagaataattcagggagtttctcagcttatattgaatcaaaaattcaattctgtttagattatattgctgtatgttaaaaatcaaatcattaaaaataaaacactgcaggaaactggatagtctcatcttatgttcgagggaagg

SEQ ID NO: 80723 - DNA, 601 bp, Human
gtacaaggtgtccctgtggcccgctgcctcagctttagccacctttatctcattgtccatgaggcccaacttcctcatgagcggctcccaggagtcaaagggcaccaagtctgcaaagtcatcgaagcactgtctcagagctggtggagaaagccacagagacagccaggtgagttgggactcagaaagggcagaggattccacatcaggcccagaacccaaggcggggaacctggagagccccgtgtgcgggcaaacctgccgctccagtgcccacccgcttcccatccacagagagcgygcccacactgcctggcctcccccacacgcaaggcactgcggggagtcaaagtcgtcagagaatcagccctcatacagggctgagaacccaccaggggagtatggatggacgttacagaggcagaaagtaaagtgcgtgagagtccgagggagggagagacagtggctgcagcgggagcttagaggagggaggaggctgcctgggctgcgcttgtcatgggagcaggtcccagggcggccacttctgcatctgtggaaagcacagggcctgggacaggggacctctgttttcacccagctc

SEQ ID NO: 80724 - DNA, 601 bp, Human
gttgcatgaagattgcctgcattattagggggactaatattaatcaatttctaaaggaaaatgttggtgagaagacactggagaactgatccattcataagcagaagaagatagttaaaacagattgagagtgaattgggatttacctgatattacggagggagattcttcctggctgacatctagaagagaagcacaggatgatgggaaaggttacatctcgaattttgcaagattcacaggtgttctacagggaaaggggacttctcaccacaccccatgcatcccctaggttagctcrtcagctaccatctgtgaagctgctggaaggggaggaaggtgtaaggggaggcagggttgttaccacacagagcaacagccatgaactcaatatagaagagcccctttttttcttccctagcatccttcaagacttaatgctaatttagtttacacatgccaggtacttcaatgtgatattttggtattcttatgccctccatctcctataaatacattgcttatattcacaagctttctcaatttcggtaaccagaagtaattgtttcaatacaatcttacctataccactcccagcaca

SEQ ID NO: 80725 - DNA, 601 bp, Human
caactattgatcgattaacatagtttgtgaaaagcaaacaaaatcagcttcctggtcaacattgcccacttcagttttacaaagagaacattaccaaatcctaccccctagaggtcgagctcccatactggtgaccagagtgacattccagaaaggttttgggaacccaagtgcagccaggacgcctcccgctgcatctggctgccccggccaacagtgtcccttacctgcggctcctgcaggcggctgccacgtgatgaaccggagcccgttcctgactcgggagggctgctttcccggktagtagccaaatgtgatgactcggctaaattttcccagccctgaattcctaacatacaagaagggaaattaggaggtgacgcagggtctgtccaggataacgggtcggcacagagtgttggaaagtgagaatcaaataagaggggaaagtcaaagtttatagagtatttgggcaggggagggaattgttctggaatgaaaccgacaagaatattgtagggtggcacaagcatgacttgctacctttgcttccccacgccatgctgaggtgtttttccttctccttgctgtgatttcccct

SEQ ID NO: 80726 - DNA, 601 bp, Human
agacagaggttgcagtgagccgagatcgggccaccgcaccccagcttgggcaacacaacaagaccctgtctcaaaaaaatgaaaaaaaaaattaatattaaaaaaatcgtcttcattttagaaaagaagaaactgggcttaaagtaatgttgaacaattaactcaaagtcaaatactggcagagcagattttaggactctgaaagatatcctttcagtcactgtgctataagcctaggttcagctcccaggcaatgtcctgtgagctgaacgagggaagacagaccgcatagacatttcaktttaaagtgtcaatatcttccctgagtccctgccattctattatattgctgacaatagaatgatctataacccaactattgatcgattaacatagtttgtgaaaagcaaacaaaatcagcttcctggtcaacattgcccacttcagttttacaaagagaacattaccaaatcctaccccctagaggtcgagctcccatactggtgaccagagtgacattccagaaaggttttgggaacccaagtgcagccaggacgcctcccgctgcatctggctgccccggccaacagtgtcccttacc

SEQ ID NO: 80727 - DNA, 601 bp, Human
ctaaaaatacaaaaattagccagacatggtggtgcacacctgtagtcccagctactcaggaggctgaggcagaagaatcacttgaacccaggagacagaggttgcagtgagccgagatcgggccaccgcaccccagcttgggcaacacaacaagaccctgtctcaaaaaaatgaaaaaaaaaattaatattaaaaaaatcgtcttcattttagaaaagaagaaactgggcttaaagtaatgttgaacaattaactcaaagtcaaatactggcagagcagattttaggactctgaaagatawcctttcagtcactgtgctataagcctaggttcagctcccaggcaatgtcctgtgagctgaacgagggaagacagaccgcatagacatttcagtttaaagtgtcaatatcttccctgagtccctgccattctattatattgctgacaatagaatgatctataacccaactattgatcgattaacatagtttgtgaaaagcaaacaaaatcagcttcctggtcaacattgcccacttcagttttacaaagagaacattaccaaatcctaccccctagaggtcgagctcccatactggtgacc

SEQ ID NO: 80728 - DNA, 601 bp, Human
tgcctataaatcccagcattttgggaggctgaggcaggcagattgcttgaggtcaggagatcaagaccagcctgagcaacatggtgaaaccccgcctctactaaaaatacaaaaattagccagacatggtggtgcacacctgtagtcccagctactcaggaggctgaggcagaagaatcacttgaacccaggagacagaggttgcagtgagccgagatcgggccaccgcaccccagcttgggcaacacaacaagaccctgtctcaaaaaaatgaaaaaaaaaattaatattaaaaaaatcstcttcattttagaaaagaagaaactgggcttaaagtaatgttgaacaattaactcaaagtcaaatactggcagagcagattttaggactctgaaagatatcctttcagtcactgtgctataagcctaggttcagctcccaggcaatgtcctgtgagctgaacgagggaagacagaccgcatagacatttcagtttaaagtgtcaatatcttccctgagtccctgccattctattatattgctgacaatagaatgatctataacccaactattgatcgattaacatagtttgtgaaaagca

SEQ ID NO: 80729 - DNA, 601 bp, Human
tcatctctgcacacgttcttcaacgaattcttcttcctctggaacatactcctgagtgagctatgtgcagaccccttggttttcacgaaccccaagaccccggctggggcttgtgttcattgccaggttgtgctctacctgatcttactgaagatacatggatttggggtaacttagaagactgttttatgctttacactgactcccatctgcttttgcaaacttgaatgattctgactcaaaatattagatttttggtcaataatccttttatttattgaagccaaaaggtatattatgaggccaaaattataaaacactttgattttatctcatctgtaaaatgagcagaagaaactgttagattgcttaaaaatccttccaacactgaacttataaatgacaatagtaggctgcgtgtggtggctcatgcctataaatcccagcattttgggaggctgaggcaggcagattgcttgaggtcaggagatcaagaccagcctgagcaacatggtgaaaccccgcctctactaaaaatacaaaaattagccagacatggtggtgcacacctgtagtcccagctactcaggaggctgaggca

SEQ ID NO: 80730 - DNA, 601 bp, Human
atctcaatcttgggtgcaggaaaagtagagcatttctcagtgttggttgcaccttctatatcagaattccccggggtacgtgttacaaactccaagccagaggtgggtgcagtggctcacacctgtaatcccagcactttgggaggctgagcatcccttgagcccaggagtctgaggctgccgtaagccatgattgcgccactgcactccagctgggttgacagagcaagatcctgtctctaaaaaataaaaataaataataataataacaataaactccaggcctgccccagaattattkgatctgaatctcagggagtgtcgggcctgagcattgcactttttgtatgtggtgcctggtgatgctacacgcctgttggtatagaagaacctctatcctggaaattaaataaagctaatccgagcccatgcagtagcagaaaccatggaagtcagggagggagctggggccgagggatgagaaagagaaagaggtcagtgtctttgcagagaacaagagattgataccatatgtttgtgaagcactttgaatttcactttaaaaataaaattaaaatcacagcagctgtttgtctatgat

SEQ ID NO: 80731 - DNA, 601 bp, Human
tgtggtttaatcttacaggttgtcagggatcatctcaatcttgggtgcaggaaaagtagagcatttctcagtgttggttgcaccttctatatcagaattccccggggtacgtgttacaaactccaagccagaggtgggtgcagtggctcacacctgtaatcccagcactttgggaggctgagcatcccttgagcccaggagtctgaggctgccgtaagccatgattgcgccactgcactccagctgggttgacagagcaagatcctgtctctaaaaaataaaaataaataataataataayaataaactccaggcctgccccagaattattggatctgaatctcagggagtgtcgggcctgagcattgcactttttgtatgtggtgcctggtgatgctacacgcctgttggtatagaagaacctctatcctggaaattaaataaagctaatccgagcccatgcagtagcagaaaccatggaagtcagggagggagctggggccgagggatgagaaagagaaagaggtcagtgtctttgcagagaacaagagattgataccatatgtttgtgaagcactttgaatttcactttaaaaataaa

SEQ ID NO: 80732 - DNA, 601 bp, Human
gctaagggctttagccagccaaggcaacttccccaggcttcagaaaccaagcagccagcatcgccttcataggcgtaagtagaactcaaggtcatgctcccatgcacggcaaagtaaatgagaactgagtggctccacctggaagattcgatctgtgattagagaaactcacagagttacatcttgagctcactacctcttctagcaaaccctacctccccatcacaagagaaaaactgtgatgtggtttaatcttacaggttgtcagggatcatctcaatcttgggtgcaggaaaagtaragcatttctcagtgttggttgcaccttctatatcagaattccccggggtacgtgttacaaactccaagccagaggtgggtgcagtggctcacacctgtaatcccagcactttgggaggctgagcatcccttgagcccaggagtctgaggctgccgtaagccatgattgcgccactgcactccagctgggttgacagagcaagatcctgtctctaaaaaataaaaataaataataataataacaataaactccaggcctgccccagaattattggatctgaatctcagggagtgtcgggcc

SEQ ID NO: 80733 - DNA, 601 bp, Human
taaaagaactgtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgtagtggcgggcgcctgtagtcccagctactcgggaggctgaggcaggagaatggcgtgaacccgggaagtggagcttgcagtgagcccagattgcgccactgcagtccgcagtccagcctgggcgacagagcgagactacgtcaaaaaaaaaaaaaaaaaaaaaaaaaaaaaaaaaaaactgtcatcaaagttttttcagaaggaacttcagtggagcaggcctaactaaccacagaccaagcaaacatacatcttacaaaacagctgctgggaggagaaatttgttcataatattttgtgtcagaccttggaaaagaaagatatcattgatgtccttttctgcttgggctgggaagtagggatggaaaggggctggcccaggattctcctctgtctttggtccatggaactaaaaacaaaacaaaacaaaatcacatgcgcca

SEQ ID NO: 80734 - DNA, 601 bp, Human
agcgagactctgtctcaaaaacaaacaaacaaacaaacacaaacaccaaactctaagtaattgcagggccagggatggggcaagagataggctagtctctgagcctttgtggcaagcctatgagctctcatgcaggaagaccctggtgtgcagcaggacccagaagacagcaacatgtgctagagtcagaatcaagatgacgaaatatccagacaagatcaaagaagacaaaagccacctccctaccatccttagaaaggggcctagaggggcagactggcttgagattcagctatctcaktggtgctatggatgagatttggtgatttcaaagcttcattagtattcctggattttcattacagttcattccttttttatcttatctttttttttttttttaatttaagacagcgtctcgctctgtcgcccaggctgcagtgcagtggcatgatctcaactcactgcagcccctacttcctgggctcaagcgatcctcccacctcagccctgagtagctgggactacaggtgcatgccaccatgcccagctaatttttgtgtttttggtagagacagggttttgccacgttgccggctgg

SEQ ID NO: 80735 - DNA, 601 bp, Human
gttcccaagtttctcattgccatgtgacgctttttagcactggggtcccgagctctttctgccaagatgaaaaacacattcttcagaggctcccgcttctggaacctcagtttccaagagacctgggtgatgggtcaaaaatgtattaatttgggagtgttcagagtcataccaatcccaaccccaatctctccctctaaagaaaatcccgtgattgcctgctcaattttaccccttctttctcctactaaagacggctgggttttgttggaaatgtactcatttggtctacataacgaaraaattgatggagaaagagggcaataaagatagtgcaggctggtgttgaggtaggtttaggagattaaggggagaggctctagagcagctatgggtgtgatagaagttgaaaaaaagaggacttgatcagtgttgatgtgatgtgggaatagggatctgtttcacagggaaaggtgtgccgttactcctcaaagagctccctttaccccttcttctccagctctttcccatttttctgctctcctttgtagccaaatgccttgaaagacatctatacttgttttctcccgtttgtctcctc

SEQ ID NO: 80736 - DNA, 601 bp, Human
tccctaccttgtcaggggcttcataggccatggttcccaagtttctcattgccatgtgacgctttttagcactggggtcccgagctctttctgccaagatgaaaaacacattcttcagaggctcccgcttctggaacctcagtttccaagagacctgggtgatgggtcaaaaatgtattaatttgggagtgttcagagtcataccaatcccaaccccaatctctccctctaaagaaaatcccgtgattgcctgctcaattttaccccttctttctcctactaaagacggctgggttttgtyggaaatgtactcatttggtctacataacgaagaaattgatggagaaagagggcaataaagatagtgcaggctggtgttgaggtaggtttaggagattaaggggagaggctctagagcagctatgggtgtgatagaagttgaaaaaaagaggacttgatcagtgttgatgtgatgtgggaatagggatctgtttcacagggaaaggtgtgccgttactcctcaaagagctccctttaccccttcttctccagctctttcccatttttctgctctcctttgtagccaaatgccttgaaagac

SEQ ID NO: 80737 - DNA, 601 bp, Human
cccaagttcaagcgattctcctgcctcagcctcccgactagctgggactacaggcgtgcaccaccatgcccagctagttctttgtattttagtaaagatagggtttcaccatgttggccaggatggtctcgatctcctgacctcgtgatccacccgcctcggcctcccaaagtgctgagattacaggcatgagccaccgcacccggccccacagtcatatttctaagcccattttgatttcaataacccagaatttttctgatttacttacatcatctaataaagtcctggtctgaagggygatatctatgaagaaggaacccaaacctttcccctggatcttgcccagaacgacggtcagagtcttcatactctcatggatgacttccaaattcacagggtcatacagtccatacaccagcaggtcgaggacaattttcttatactttctcacctgtcaccaaggtttgaaaagcagtaatagcacaggaactgctccccataggttgaaaagcaaccccacatctaagctactaataacctaggacttgaactaacacaccagggcttttttcaagatctgcacaactctcattaaaat

SEQ ID NO: 80738 - DNA, 601 bp, Human
catttctttctttctttttttatttgagagggagtcttgctctattgccaggctggagtgcagtggcgtgatctcggctcactgcaacctccacctcccaagttcaagcgattctcctgcctcagcctcccgactagctgggactacaggcgtgcaccaccatgcccagctagttctttgtattttagtaaagatagggtttcaccatgttggccaggatggtctcgatctcctgacctcgtgatccacccgcctcggcctcccaaagtgctgagattacaggcatgagccaccgcacccrgccccacagtcatatttctaagcccattttgatttcaataacccagaatttttctgatttacttacatcatctaataaagtcctggtctgaagggtgatatctatgaagaaggaacccaaacctttcccctggatcttgcccagaacgacggtcagagtcttcatactctcatggatgacttccaaattcacagggtcatacagtccatacaccagcaggtcgaggacaattttcttatactttctcacctgtcaccaaggtttgaaaagcagtaatagcacaggaactgctccccatag

SEQ ID NO: 80739 - DNA, 601 bp, Human
agctcacatttctttctttctttttttatttgagagggagtcttgctctattgccaggctggagtgcagtggcgtgatctcggctcactgcaacctccacctcccaagttcaagcgattctcctgcctcagcctcccgactagctgggactacaggcgtgcaccaccatgcccagctagttctttgtattttagtaaagatagggtttcaccatgttggccaggatggtctcgatctcctgacctcgtgatccacccgcctcggcctcccaaagtgctgagattacaggcatgagccaccrcacccggccccacagtcatatttctaagcccattttgatttcaataacccagaatttttctgatttacttacatcatctaataaagtcctggtctgaagggtgatatctatgaagaaggaacccaaacctttcccctggatcttgcccagaacgacggtcagagtcttcatactctcatggatgacttccaaattcacagggtcatacagtccatacaccagcaggtcgaggacaattttcttatactttctcacctgtcaccaaggtttgaaaagcagtaatagcacaggaactgctcc

SEQ ID NO: 80740 - DNA, 601 bp, Human
accttgttcccacagcaacaaaccacccgcagctcacatttctttctttctttttttatttgagagggagtcttgctctattgccaggctggagtgcagtggcgtgatctcggctcactgcaacctccacctcccaagttcaagcgattctcctgcctcagcctcccgactagctgggactacaggcgtgcaccaccatgcccagctagttctttgtattttagtaaagatagggtttcaccatgttggccaggatggtctcgatctcctgacctcgtgatccacccgcctcggcctcccraagtgctgagattacaggcatgagccaccgcacccggccccacagtcatatttctaagcccattttgatttcaataacccagaatttttctgatttacttacatcatctaataaagtcctggtctgaagggtgatatctatgaagaaggaacccaaacctttcccctggatcttgcccagaacgacggtcagagtcttcatactctcatggatgacttccaaattcacagggtcatacagtccatacaccagcaggtcgaggacaattttcttatactttctcacctgtcaccaaggttt

SEQ ID NO: 80741 - DNA, 601 bp, Human
agtttcgggctgaacgatgtgccggtgcactttttgcttagcctgatttgtcatctggtagttgagtgtagccctatagtcagaggagctggtggcatgtccacttcctggctctgtgaatttgggcaagttctaacctttctgtgctttggtttccttgtctacaaagtgaagataattacagtgcccatctcacagggttattgggaagattatatgagatgattcatgtaaattgcctagcactgtgcctggcacacagtgagggctcactagacactaatcattgctattgccacayttataagacagcattgactacatgttagtcaatcagtgtacatcatcatcagtgtaaatatacccacttctctgttaagatgaaaactcaccaggcacagtggcttacacctgtaatcctaacactttgggaggccaaggcaggtgggtcatttgagcccaggagtttgagactagcctgggcaatatagtgaaaacccatctttaccaaaaatacaaaaattagccagctgcggtggcatgtgcctatagtcccagctacttgggaggctgaggtgggaggatcaattgagcccagaag

SEQ ID NO: 80742 - DNA, 601 bp, Human
aaatggttgaaggccagacacatgtctcatgcctgaaatcccagccctttgggaggccgagacaggagaatcgcttgagcccggtcagagaccagcctgggcaacataacaagaccctatctctacaaaaactacgaaaattagccaggcacagtggcatgcacttgtggtcccagccactcaggaggctgaggtgggaggatcagttgagcctgggaggttgaggctgcagtgagctgtgttcctgccactgtactccagcctgggcaatacagcgagaccctgtctcaaaaaaaaaaawaaaagtggttgaatgacaaacaagtcctcgaagttcagatggctcctccaagagatttagagccatctccccggagacatctgcttacacttcagggtggtaagtagggaccttcgcccgctccctccccagagaggactggcttacattcaagagcaaaaatccctctgtgtctctggagcaggtgagacacatgtgcccagctcccatatgagctccaagttacataaggtcaaggcctcttctccccttctgtcctgctgacacatctggctctcgccacgtggctccggagagaat

SEQ ID NO: 80743 - DNA, 601 bp, Human
ctggcctccaactcctgtgctcaaatgaccctcatgcctcagcctcctaagtagctgggattacaggcacacaccaccatgcctggcttagggttgtattatcttcatggctctattagtgagtgtttgtgtatgtgtgtgtgtagtgtgtgtgtgtgtgtgtgtgtgtgtttaacaaattttaatggagaatgtaccccattcaaagccataccctaatgctttaagatgtacagacacgtaagacagatgctcgccccgctaggagtctgacaaccatctaactgggaacacacgcacrggtgagcttcatggcctcagatagtgaagagtgctatctgtaatggagatgtaaactatcagcaaacagctctgcataagaatttctgtgtttctacatggccggggatttctgctcaaaaattccaggcaaccagggtttaaaaaaatggttgaaggccagacacatgtctcatgcctgaaatcccagccctttgggaggccgagacaggagaatcgcttgagcccggtcagagaccagcctgggcaacataacaagaccctatctctacaaaaactacgaaaattagccaggcacagt

SEQ ID NO: 80744 - DNA, 601 bp, Human
attgtgaagtatctttaaaaaatttagcacatgatgcatacagaaattgtcttagggtttttgtctttttttgtttttgtttttgtttttgttttagagacaacatcttgctacattgcccaggctggcctccaactcctgtgctcaaatgaccctcatgcctcagcctcctaagtagctgggattacaggcacacaccaccatgcctggcttagggttgtattatcttcatggctctattagtgagtgtttgtgtatgtgtgtgtgtagtgtgtgtgtgtgtgtgtgtgtgtgtttaacwaattttaatggagaatgtaccccattcaaagccataccctaatgctttaagatgtacagacacgtaagacagatgctcgccccgctaggagtctgacaaccatctaactgggaacacacgcacgggtgagcttcatggcctcagatagtgaagagtgctatctgtaatggagatgtaaactatcagcaaacagctctgcataagaatttctgtgtttctacatggccggggatttctgctcaaaaattccaggcaaccagggtttaaaaaaatggttgaaggccagacacatgtctcatg

SEQ ID NO: 80745 - DNA, 601 bp, Human
atcatattgtgaagtatctttaaaaaatttagcacatgatgcatacagaaattgtcttagggtttttgtctttttttgtttttgtttttgtttttgttttagagacaacatcttgctacattgcccaggctggcctccaactcctgtgctcaaatgaccctcatgcctcagcctcctaagtagctgggattacaggcacacaccaccatgcctggcttagggttgtattatcttcatggctctattagtgagtgtttgtgtatgtgtgtgtgtagtgtgtgtgtgtgtgtgtgtgtgtgtktaacaaattttaatggagaatgtaccccattcaaagccataccctaatgctttaagatgtacagacacgtaagacagatgctcgccccgctaggagtctgacaaccatctaactgggaacacacgcacgggtgagcttcatggcctcagatagtgaagagtgctatctgtaatggagatgtaaactatcagcaaacagctctgcataagaatttctgtgtttctacatggccggggatttctgctcaaaaattccaggcaaccagggtttaaaaaaatggttgaaggccagacacatgtc

SEQ ID NO: 80746 - DNA, 601 bp, Human
ctgagggtcacagagacccagcaagactgaggaacactaatcatattgtgaagtatctttaaaaaatttagcacatgatgcatacagaaattgtcttagggtttttgtctttttttgtttttgtttttgtttttgttttagagacaacatcttgctacattgcccaggctggcctccaactcctgtgctcaaatgaccctcatgcctcagcctcctaagtagctgggattacaggcacacaccaccatgcctggcttagggttgtattatcttcatggctctattagtgagtgtttgtgtrtgtgtgtgtgtagtgtgtgtgtgtgtgtgtgtgtgtgtttaacaaattttaatggagaatgtaccccattcaaagccataccctaatgctttaagatgtacagacacgtaagacagatgctcgccccgctaggagtctgacaaccatctaactgggaacacacgcacgggtgagcttcatggcctcagatagtgaagagtgctatctgtaatggagatgtaaactatcagcaaacagctctgcataagaatttctgtgtttctacatggccggggatttctgctcaaaaattccaggcaa

SEQ ID NO: 80747 - DNA, 601 bp, Human
ggtgcacgggtttttatatcagtgttttgtagtctaagtcctcctccaggtaaaccagagggaggagggctggggtgggccttcacagcggggaagaagcacaaagaactgagggtcacagagacccagcaagactgaggaacactaatcatattgtgaagtatctttaaaaaatttagcacatgatgcatacagaaattgtcttagggtttttgtctttttttgtttttgtttttgtttttgttttagagacaacatcttgctacattgcccaggctggcctccaactcctgtgctcaartgaccctcatgcctcagcctcctaagtagctgggattacaggcacacaccaccatgcctggcttagggttgtattatcttcatggctctattagtgagtgtttgtgtatgtgtgtgtgtagtgtgtgtgtgtgtgtgtgtgtgtgtttaacaaattttaatggagaatgtaccccattcaaagccataccctaatgctttaagatgtacagacacgtaagacagatgctcgccccgctaggagtctgacaaccatctaactgggaacacacgcacgggtgagcttcatggcctcagatag

SEQ ID NO: 80748 - DNA, 601 bp, Human
aaggcccaaggcacttaaggaacttgcccaaaatcacactgtcaggtaacagagccagtatagtaacctaaacacctgactcatggtgcacgggtttttatatcagtgttttgtagtctaagtcctcctccaggtaaaccagagggaggagggctggggtgggccttcacagcggggaagaagcacaaagaactgagggtcacagagacccagcaagactgaggaacactaatcatattgtgaagtatctttaaaaaatttagcacatgatgcatacagaaattgtcttagggtttttgtytttttttgtttttgtttttgtttttgttttagagacaacatcttgctacattgcccaggctggcctccaactcctgtgctcaaatgaccctcatgcctcagcctcctaagtagctgggattacaggcacacaccaccatgcctggcttagggttgtattatcttcatggctctattagtgagtgtttgtgtatgtgtgtgtgtagtgtgtgtgtgtgtgtgtgtgtgtgtttaacaaattttaatggagaatgtaccccattcaaagccataccctaatgctttaagatgtacagacacg

SEQ ID NO: 80749 - DNA, 601 bp, Human
agagtcaaggtcttaccttggcaacctggggatttctgtcctgtaaatggatcaggagggaatctcgtgtctgcttaacctgactggtgaaaaattttttccatttcctcccggcaaaggcagccaattgcccaaacaaaacaaaggccgagtatctcagactgtcgttctcctgcggtccccatcaacaaaacaataagaaagccagatcattaccaaaaggcaactgcatctgaacacatcacagccatcggtcagaacacatcacagccgtcaatcagaacacatcacagccatcgaycttgactgtacattacagggtgggtggtgagatctggtctaaagcacttagctgggtgggtgggggtggcttgaagagggcccaaaggcttcaatgaacctcttctccagcagacgagaggactagcctgggaaatcactagtgctactcccaccttcccagattttttgttcgttatttcatgttttggagatagaatacatttataaacttcccaaaattcaaaataaccaaaaagctttacaggaaaagtaggtctacttcctactcctctccatcagccaccaaattttcctcccc

SEQ ID NO: 80750 - DNA, 601 bp, Human
aggtggggcagatggaaaccaacactcttgctcaaagagagattacacaccaaagaggcaccttgtcaaggatgcacacagaaacgctgctaagtatctacagcagtgctggcaggaaccctagggtctggcgtctcaactcgcaactccctttatgaatagcatggagatgtcactctgttggttgcagagtcaaggtcttaccttggcaacctggggatttctgtcctgtaaatggatcaggagggaatctcgtgtctgcttaacctgactggtgaaaaattttttccatttcctcccrgcaaaggcagccaattgcccaaacaaaacaaaggccgagtatctcagactgtcgttctcctgcggtccccatcaacaaaacaataagaaagccagatcattaccaaaaggcaactgcatctgaacacatcacagccatcggtcagaacacatcacagccgtcaatcagaacacatcacagccatcgatcttgactgtacattacagggtgggtggtgagatctggtctaaagcacttagctgggtgggtgggggtggcttgaagagggcccaaaggcttcaatgaacctcttctccagca

SEQ ID NO: 80751 - DNA, 601 bp, Human
gtggagcccagcaagatggctcacgcctataatcccaacaccttgggaggctgaggtgggtggatcacctgaggtcaggagttcgagaccagcctggccagcatggtgaaatcccatctctacttaaaatacaaaaaattagcagggcgtggtggtgggcacctgtaatcccagctactcaggaggttgaggcaggagaattgcttgaaccccagaggcggaagttgtagtgagccgagatcacaccactgcactccagcctgggcaacaagagcaaaactgtctcaaaaaaaaaaaaagraagaaagaacgaaggaagaaaggaaggaaggaaagaaggaaggaaggaaagaaaagagaaaagaacagaaaagaaaagaagccatgggtggaaatctataccaggcacaatgacaaaagctaagtgggcatgaataaatatcctcattatgtgggctgctgcaccattgattaaacctgtgcctctctgccctcaaccccattaccctgagcttatcttgcattgacaggtgctgggcttgggcaggtggggcagatggaaaccaacactcttgctcaaagagagattacacaccaaaga

SEQ ID NO: 80752 - DNA, 601 bp, Human
aggcagatcacttgagatcaggagttcaagaccagcctgggcaacgtggtgaaaccccatctctactaaaaatacaaaaattagccgggtgtggtggtgcacgcctgtaatctcagctactcaagaagctgaggcacgagaatcacttgaacttgggaggtgaaggctgcagtgagccaagatggtgccactgcacttgctcttctcagaaaaaaagaaaaaataaaaaaataaacatagttggcctgagtcattttaagggggtaactctttcttgtgcttggccaccttccgtgttaamcaccaggagggcagggaccggaaaataattctctcctaccctggctcactcaccagctgctggtagagcttagtgttcctttgatcttcttcactctggaagctgtattcctcctttagtttcagatatggagaacaggcttgaaatgttgttttgcaagcctgagaaaaataatattactattttatttattagagagttccataatcccaagcaaggaaaagtatcctagaggattgcacccaatctgtggtcaggggcccactgaaagtgtgaaagtaacttccaggtagtttcaaa

SEQ ID NO: 80753 - DNA, 601 bp, Human
tattatttttgcctttgattgctctcccagcaccctctttcccattacaatcccaagaggcaagcagtgagaagaggcatccagtgagataaaacaggggaacatgatggctcagcaatgcactcatacagaaccatttccctgctgctctgcgcttacagaattttatttgcgtagaagaactgcaggatctctggatgatagtggctctgaaagaaattagcaaaggtacgcgtgagggcaggattcaacaaacttccttgacaatgtaactagtaggcagtgatcagtgcagggcatgtggataagcaggagaggtggaggcatcatctgtatccagctagtgacctgaattggaactgccgatatatctcgtgcttgatcctctaggcgttttgccatttacattgtatgatgggtcaattacaatcaaaacacagttggcttggccgggcatgctgactcatgcctgtaatcccagtactttgggaggctgaggcaggcagatcacttgagatcaggagttcaagaccagcctgggcaacgtggtgaaaccccatctctactaaaaatacaaaaattagccgggtgtggtggtgca

SEQ ID NO: 80754 - DNA, 601 bp, Human
gcccgctcaaagcccaaaatctccctcagagaaggtaatactaccagatccttttctagcttcctctaaccatctctttagaaagtagagagcataaccactatcctttccctttgttaaatcttttctttttaattttaatgcgtgagtgtgtggatggttctaaggtacaattttgaaaacttaatttctgcctaggttactctttctgttggggattctaaatatacttgagatatctaaagcaagcagtactaaattatgtagaatgctatacattttaatttatgtagaatgctgyatatttaatttaatttaattttgttcacattgttttatttacttatttttccccaaccaccagataggactgtcattcttagactttagctgacctaagaataatttgggatattgttaaaattcttagaaatctatatttgcatgtttaattccttaagtttctgatttaattagtctgaaattagctcaactttataaataaccaaaatgagtcctaaaactattaaatgattctccccaaagtagaattattcatgtttagagctaggataattcccattcctctgaactatttcat

SEQ ID NO: 80755 - DNA, 601 bp, Human
ttacatttaatacactagactggcagaaaaatcagtggagacaaggaataggtaaacaacgggctctttaaaagtaacttaatgaaatggaagtaaatgcaaatgaaatggggaatgcagaaccagccaaattttatgtcctggagtgattgattgtatcctgattaagaaaacctccatcagtcagaaagaccagaggccatcttccccggggaattcccaggtaatatcttcctgtcgtttatacttgggtttctccatcctaaaacttggaagctttttcttttaaaaaaatgttatwgtttatccatgttatttttattctgtcacttctcattcatatcatttcactgtggcataaagaatcagggatggctgccatcatctgactgagaacaggagacttaggaaggccagactaagtaccgtccttctgagaccctcaaagaaggctatgcccagggtaactgatatatgggtcttccctattgactcttagtactcatccttcttgatctgattcagggctatttccatcaatttttcctgaccaagaaggagtcgccactccttacccaggagacacaaacacagctcctgc

SEQ ID NO: 80756 - DNA, 601 bp, Human
tagctgggattacaggggcctgtcaccatgctgggctaatttttttgtatttttagtagagacggggtttcactatgttggccgggctggtcttgaactcctgacctcaggtgatccgcccacctcagcctcccaaagtgcagggattacaggagtgagccactgcgcctggcctagttgaacagcttttaagtagcagagttaggactcatttccagagttctgtgacttccttccttccttcctttctctctctctctctctctctctctcccctctctctctctctctctctctctccccctctctctctctctctttctttctttcttagatggagtttcgctcttgttgcccaggctggagtgcacgtgccacatgctcggctacttttttgtatttttagtagacatggagtttcaccacgttggtcaggctggtctcaaactcctgacctcaggtgatccatcctcctcagcctcccaaagtgctgggattacaggtgtgagccactgcacccagccgagtcgtgtgatttctaaggtaatagctgaaatattttgctgtgagatatatatgtatatgtatctatacatataca

SEQ ID NO: 80757 - DNA, 601 bp, Human
gatgaaagacggggcagtctcatcaaaagtggcaatccaggccagtgatcaaagattctgccttcagaataaaatactctttatttataacttctatacataactttgagcattgtgaccccccaaaatgacaattaaatgacctcaaagcctcatttccttaactataagatgaatactataaaacacctacttcacaggtagttgtgttgatgaagaaagtgcattcttggcacagcgtatgcgctcaataagttgttataatgatcacttgtcctgtgttgagcgatctgaattataygctcgtatgtatcaatagtttgttaagtattcactcacttctgatttcattaccagctatgagattttttttactgaacacttttattaatttaatgaataatgggttccttccaagttccaaagtctgtgctacagatattaatgcaacttgacgtcgctgtcattaatgagcctacagtgtcatttatgggcctggaaaatatgagggcttctttatatttcatttttttcaatttgttagtaaatttgtcaattgacaaatataaattgtgtatagttattgtgtacaacagaatat

SEQ ID NO: 80758 - DNA, 601 bp, Human
gaatctgcatttttattaatatccacaggcgattctatgcatattacattttgagaaacactgttgtgctttcaacacattacttcccttatcagcagctgaatcgttaataagtcactcatttgctttcttagttaagctggctctcagcagtcagcactcatgtatttgagtgctgggtcaggcttacagatggctgctcatctgtgccggccctatcggattgcatggggcatactgggagttccaggagcagcattagagaggtgcgtgtcaagatgaaagacggggcagtctcatyaaaagtggcaatccaggccagtgatcaaagattctgccttcagaataaaatactctttatttataacttctatacataactttgagcattgtgaccccccaaaatgacaattaaatgacctcaaagcctcatttccttaactataagatgaatactataaaacacctacttcacaggtagttgtgttgatgaagaaagtgcattcttggcacagcgtatgcgctcaataagttgttataatgatcacttgtcctgtgttgagcgatctgaattatatgctcgtatgtatcaatagtttgt

SEQ ID NO: 80759 - DNA, 601 bp, Human
ttttggatcagcagcattggcatcacctaggatcttgttagaaatttagaatattaggcttattcaagacctgttgaattagaatctgcatttttattaatatccacaggcgattctatgcatattacattttgagaaacactgttgtgctttcaacacattacttcccttatcagcagctgaatcgttaataagtcactcatttgctttcttagttaagctggctctcagcagtcagcactcatgtatttgagtgctgggtcaggcttacagatggctgctcatctgtgccggccctatyggattgcatggggcatactgggagttccaggagcagcattagagaggtgcgtgtcaagatgaaagacggggcagtctcatcaaaagtggcaatccaggccagtgatcaaagattctgccttcagaataaaatactctttatttataacttctatacataactttgagcattgtgaccccccaaaatgacaattaaatgacctcaaagcctcatttccttaactataagatgaatactataaaacacctacttcacaggtagttgtgttgatgaagaaagtgcattcttggcacagcgtat

SEQ ID NO: 80760 - DNA, 601 bp, Human
tgtggcacatgactatacatgtttacgtctgcctgtatgaaagttaaaaattgcaggctctggcaattgtaaagtctctaaatttcgacaaattactcaactccctgagtcttaattccctaatttgtaaaataaaagttgttcatgtaattaaatgacataattcatacaaatagcacttaacaatcagtaaaagttggttactcttataattactattttgataagtagtatacttatctgaataaacaccagtataaatacatatttacaagaggtaaagggtataaaatatttacaygacttttaaatccctacgggatccatttcttacttcactctctgttcttatctgtatgaaagaggtttgctcaggcaaaacctatactctaatcaaaagaaatgacctgaggttctaggctttttcccagcgttcctacaacattgttgaaatgtgtaaggtccaggttacatcacctcctctatttacctcctcatagaaatccatgtgggttaagatctcactccaattagccactagcaaagcttgtataggtttttattctgaggcttattactgtctcacaattctatgtttatt

SEQ ID NO: 80761 - DNA, 601 bp, Human
tatgggagcaccatgctaatgtggtccattattgaataacactgttatgtggcacatgactatacatgtttacgtctgcctgtatgaaagttaaaaattgcaggctctggcaattgtaaagtctctaaatttcgacaaattactcaactccctgagtcttaattccctaatttgtaaaataaaagttgttcatgtaattaaatgacataattcatacaaatagcacttaacaatcagtaaaagttggttactcttataattactattttgataagtagtatacttatctgaataaacaccrgtataaatacatatttacaagaggtaaagggtataaaatatttacatgacttttaaatccctacgggatccatttcttacttcactctctgttcttatctgtatgaaagaggtttgctcaggcaaaacctatactctaatcaaaagaaatgacctgaggttctaggctttttcccagcgttcctacaacattgttgaaatgtgtaaggtccaggttacatcacctcctctatttacctcctcatagaaatccatgtgggttaagatctcactccaattagccactagcaaagcttgtata

SEQ ID NO: 80762 - DNA, 601 bp, Human
cagaaatgcaatgtgttatgacgttacgacagctacaatgtcactacatgataggaatttccagcttcattacaatcttatgggagcaccatgctaatgtggtccattattgaataacactgttatgtggcacatgactatacatgtttacgtctgcctgtatgaaagttaaaaattgcaggctctggcaattgtaaagtctctaaatttcgacaaattactcaactccctgagtcttaattccctaatttgtaaaataaaagttgttcatgtaattaaatgacataattcatacaaatarcacttaacaatcagtaaaagttggttactcttataattactattttgataagtagtatacttatctgaataaacaccagtataaatacatatttacaagaggtaaagggtataaaatatttacatgacttttaaatccctacgggatccatttcttacttcactctctgttcttatctgtatgaaagaggtttgctcaggcaaaacctatactctaatcaaaagaaatgacctgaggttctaggctttttcccagcgttcctacaacattgttgaaatgtgtaaggtccaggttacatca

SEQ ID NO: 80763 - DNA, 601 bp, Human
aaaagtataatacaggactgataaaactttggccaatccaggctaaagctgtggactgagtattgcccagtagaataatccccagagaggattattccagctccattacctggcttttttgcatgttttatgacagtttttctttttcctgagtatcagggtcagttacccttgaaaatatgagtagtcctcttccggccatttggtttctgagtataaagacaccaaagtttccagatgatagctgtagtttatttatggaaaaagtgtacctcctttcgaaaccagtgaatttaacatracaagagtccacagttgtgagggcagaagacaccacatcttccatgacccatgtatgttttcttttggggtaacattacatgaaggtcttttatacaatgtatatattgaacacttgactgcaagcaaagaacaaaatatagggatggaaaacaaaataaaacataaaatatgaaaaaatttaaatttaaggagattactaagacaagataatgcaaaaggaaaagtaaactaatgaaaaacccaacgaaatagtgaaagttgtgcaaataaaatggatatgcaaaaattctgtgctatt

SEQ ID NO: 80764 - DNA, 601 bp, Human
tgactgtagactgctggaagttcaaccaactagtagttacaaccactggacagatttcttagattcattagccttaggtacatgacaggcattcatttgataaatacttttattctatcccacgcagaaaacaataatttaaaaaatcagaaataattcatgtttatatggaacagagagcaattcacatttacagttttgccccggtgttatgttaattctcataccctctgtcatgatatagacttaatgtattaagagttcaatatttgtgaaagggaaggggaaaaagcagaatttsacagaaagaaaagtaaaagtataatacaggactgataaaactttggccaatccaggctaaagctgtggactgagtattgcccagtagaataatccccagagaggattattccagctccattacctggcttttttgcatgttttatgacagtttttctttttcctgagtatcagggtcagttacccttgaaaatatgagtagtcctcttccggccatttggtttctgagtataaagacaccaaagtttccagatgatagctgtagtttatttatggaaaaagtgtacctcctttcgaaacc

SEQ ID NO: 80765 - DNA, 601 bp, Human
gtgcccagcacagtgggaataaaacacaggttctcagagtgggtaaatggaagcgatgtttagtaatgacaacactgttttttccttcataataaaaatgttttcctcatattaaaaaaattaacacaatggatattgatttagtttgcatactgtgtcctggaagatatggccacattgtctcacgtatcatcacttaactgacacttcagattagtgtaatttcattactttgtcagactagcagcagtttcagaaagaacaaaaggattacgttgttagggtcctaccttctcctatyttcccaacgccaggtcataaattaggaataatttgcagcataaacagatggtgaggtgttgggtctgataagagaagaaaaggactataccctaaagaagttacgagaataagatagaatctaccagcaagatatgacaaagtaagcatgatacattgagcttgcttagtccaagaggttagaaaatgaaattatataggaaagagtatatgacttgtgagtcctgtcacaaaatatagaatttaatatccagctaaaaccttcagacatgaaacaaacattttgtggaaattgctccca

SEQ ID NO: 80766 - DNA, 601 bp, Human
ttctggcgagatcctcagaaagcctctactcattggtggaaggggaaagggagaaggtatcacaggcaagaggaaggaagcaagataaaacgaaagaggaagaagtagccaggctctttttttaacagccagatctcacaggaacatagagtgagaactcactcaatcctgcaagaatggtaccacgcccttcatgagggattcacccacatgacacaaacaactccacactaggccccatctccaacattggggattaaattttaatatgagatcaggaggggacaaatgtctaaagcaygtaattgacctaacaggattcttgctatcagcaagccagaattatcacatatcaagtgggaatggtagaatatgaggaaatcaattaaacatctagagtaaccagatatggaggggaaggggctttggttaaactgacctagcatgactcttgctaaaatcgaacaatatggagataaatatgaaaatcaaggccaagttgagaacacagttcagaggaacctgggtagaggagatagtctttgtcattaggtagaattcccattgaaatgtcaaagacaggaatctgtcaccttagaaa

SEQ ID NO: 80767 - DNA, 601 bp, Human
tatctggttctggcgagatcctcagaaagcctctactcattggtggaaggggaaagggagaaggtatcacaggcaagaggaaggaagcaagataaaacgaaagaggaagaagtagccaggctctttttttaacagccagatctcacaggaacatagagtgagaactcactcaatcctgcaagaatggtaccacgcccttcatgagggattcacccacatgacacaaacaactccacactaggccccatctccaacattggggattaaattttaatatgagatcaggaggggacaaatgtcyaaagcacgtaattgacctaacaggattcttgctatcagcaagccagaattatcacatatcaagtgggaatggtagaatatgaggaaatcaattaaacatctagagtaaccagatatggaggggaaggggctttggttaaactgacctagcatgactcttgctaaaatcgaacaatatggagataaatatgaaaatcaaggccaagttgagaacacagttcagaggaacctgggtagaggagatagtctttgtcattaggtagaattcccattgaaatgtcaaagacaggaatctgtcacc

SEQ ID NO: 80768 - DNA, 601 bp, Human
ctcaactctaaatgaacagtgaaaagtaagaatgtatggaaaaggagtaaggttggggacataggttactaagtagaaaattattaaaaggaaacatcaagagtagggaagattttggcttagtctgttttgtgttgctgtaaaggaaaatgtctcagtctaggtactttatagcaaaatgggtttatttggctcacagttctgcagactgtacaagaaacatgacaccaatatctggttctggcgagatcctcagaaagcctctactcattggtggaaggggaaagggagaaggtatcayaggcaagaggaaggaagcaagataaaacgaaagaggaagaagtagccaggctctttttttaacagccagatctcacaggaacatagagtgagaactcactcaatcctgcaagaatggtaccacgcccttcatgagggattcacccacatgacacaaacaactccacactaggccccatctccaacattggggattaaattttaatatgagatcaggaggggacaaatgtctaaagcacgtaattgacctaacaggattcttgctatcagcaagccagaattatcacatatcaagtgggaa

SEQ ID NO: 80769 - DNA, 601 bp, Human
cttcacgtgcaagcatcgggccctccttcctggaggctgtgcatggagctgctattctttctaatggtgctcctgggccctgctggacgccactttgctgggcattttgcttgttttccctgtggggctgtcaccagctggtgctgtcatgaacactcctgtccagcattcggcaggtgctctcctggatggagttcagaagcgacgttgctgggtccaaggggcatgccccttttacattctaaaattctatgggacctcagtggggctttggttctctgaagaggaattgtgaagggcrccctggggcctgttggaagccttcacccagcaggagtcacctatgtggggagctgtgttggggtctctgcccccttctggaaggtgtcaagcacttttgccaaacaaacaactgcctcaggccctccctggagaagctgagacaataggtgaccagggcatgacgggtggttgcaggagacgggaccacaggctctggagctccttagctggacagagcagctccctgagctcagagaagccctgtcctgctcgttagagggctgttcagcctagtcctggatgggtgtggctgtcagca

SEQ ID NO: 80770 - DNA, 601 bp, Human
gcaggatctgccgtggtcaaacgtgggtcagtgtcaactgggaaagcagaagtctgcggccaagctggggacctcccttccctcttctccctgcagcatgtggcgggggcagggtgaggtcagggagaatggcagataggacaacctcatgggtcatgagtcatgaggctgggtatgggtgcagctaggaagggcccaaggtgaattttctccaagagagctttacgaaagggacctggggactcacaggggcggcttcgtgaccatcccaaccccaacccctcctccaggaagcccgtcygagccagccctgccagtctgagctcctacctctgtggatcctgcctgtcgtccacacctgactgccatgtcctctaggctttcagggaacacaaatcttatctcttgggcctgtcctggctgggcctccctcctgctggctctgtggccctcatcgctggaggcctcgcccctcaaggctctgccctgtgtgcaccgtgggcctagcggggctctcacagcacttcactggccctggtggtcattcggggtcagcccctgtgcacctctcccgttacccacggaggacatttcccagatg

SEQ ID NO: 80771 - DNA, 601 bp, Human
aaacttgctcaggggttgccctggtctctgacccaacagctggtgggggaggcacccacctggcctgtgtgacccccagctagttcttcgctgggcgacactggccataaacaggtcagtcagaagcctgccctgaacccctcgaaggcctcatccctccctatgggagaccaggatggcggctctggagctcaaggccgtgcactggaggtgggcctgggctgtggggcaggatctgccgtggtcaaacgtgggtcagtgtcaactgggaaagcagaagtctgcggccaagctggggacmtcccttccctcttctccctgcagcatgtggcgggggcagggtgaggtcagggagaatggcagataggacaacctcatgggtcatgagtcatgaggctgggtatgggtgcagctaggaagggcccaaggtgaattttctccaagagagctttacgaaagggacctggggactcacaggggcggcttcgtgaccatcccaaccccaacccctcctccaggaagcccgtctgagccagccctgccagtctgagctcctacctctgtggatcctgcctgtcgtccacacctgactgccatgtcc

SEQ ID NO: 80772 - DNA, 601 bp, Human
gtgtctgccggaggcctcggagtcgcatccaccggtgtttattgacagctgactggtgctgtgccctgagacccaggccctgccctctggcactcagtctaccaggggccaaggcctgcaccctccctctgggctcaccttggtcaagcctctggtggacttttaaggcccacggggaacccccccacagacccccttcccactctgcaggtgggccgctgaggcctctgcagacaggcctgagcagcagggcctgtgcttgtcgaggccccatggctcccgccatggccagggtgagatkcagagggccacggagcctgcggtggggccctggggtttgacactggggccctgcctggaatggggccttggtgtgatgggagctgggggtggggtggagcctgcctgggccgaggggctgtctggtcgggagcgattcttcagcagcagagacttgagtcatggctggggcctcctggcctctggggggaccttaagacattttttccatggaaagtagctgctggctctctgcttaccggggagctctctgtcccctcccactgcctgctgagggtttggtgggggctgcttcacttct

SEQ ID NO: 80773 - DNA, 601 bp, Human
gtagtctcagaaacgccttgaaatgaagcctgaaggggaagcccagttccatggtgtggacgagcgtgtctgccggaggcctcggagtcgcatccaccggtgtttattgacagctgactggtgctgtgccctgagacccaggccctgccctctggcactcagtctaccaggggccaaggcctgcaccctccctctgggctcaccttggtcaagcctctggtggacttttaaggcccacggggaacccccccacagacccccttcccactctgcaggtgggccgctgaggcctctgcagacrggcctgagcagcagggcctgtgcttgtcgaggccccatggctcccgccatggccagggtgagattcagagggccacggagcctgcggtggggccctggggtttgacactggggccctgcctggaatggggccttggtgtgatgggagctgggggtggggtggagcctgcctgggccgaggggctgtctggtcgggagcgattcttcagcagcagagacttgagtcatggctggggcctcctggcctctggggggaccttaagacattttttccatggaaagtagctgctggctctctgct

SEQ ID NO: 80774 - DNA, 601 bp, Human
cccccagggcaggaagggtttgcctgccacgtggcaagtacttctgccttgaggccgtcacagacagggtctctggactgtggtgtagtgtcctgtcatctccaggtgtagtctcagaaacgccttgaaatgaagcctgaaggggaagcccagttccatggtgtggacgagcgtgtctgccggaggcctcggagtcgcatccaccggtgtttattgacagctgactggtgctgtgccctgagacccaggccctgccctctggcactcagtctaccaggggccaaggcctgcaccctccctytgggctcaccttggtcaagcctctggtggacttttaaggcccacggggaacccccccacagacccccttcccactctgcaggtgggccgctgaggcctctgcagacaggcctgagcagcagggcctgtgcttgtcgaggccccatggctcccgccatggccagggtgagattcagagggccacggagcctgcggtggggccctggggtttgacactggggccctgcctggaatggggccttggtgtgatgggagctgggggtggggtggagcctgcctgggccgaggggctgtctggtcg

SEQ ID NO: 80775 - DNA, 601 bp, Human
ctgtggggtggggccggggtctgtgtccctctgtgtcctgtggggtggggccggggtctgtgtctctcacagtgtccccagcttctggtcactatctctgtccctcctgccctggggtcatcctgagctgggtcctgcctgcaatgaaatctcaggagctggggtggttctctctgctgcttctctgcccaagagtccaagggcttcccagggacagtgctgcaccctgatggagcccaggcctctgggcgaaggacacagcctctcccagacctgccccagacccctgaggctttttagygcaaggggacccccagggcaggaagggtttgcctgccacgtggcaagtacttctgccttgaggccgtcacagacagggtctctggactgtggtgtagtgtcctgtcatctccaggtgtagtctcagaaacgccttgaaatgaagcctgaaggggaagcccagttccatggtgtggacgagcgtgtctgccggaggcctcggagtcgcatccaccggtgtttattgacagctgactggtgctgtgccctgagacccaggccctgccctctggcactcagtctaccaggggccaaggcctgc

SEQ ID NO: 80776 - DNA, 601 bp, Human
gggcctccttcaaggcccttcccctgtaagcccctccgtgtcgggctctgctgtgtcttccgagaccacacctgtcctaggtgcctgggtccaggtgaggcgctccctgctgccagcagtggacagagactggttttaattaaagctcccagcaaccacccctatcgccgtggaaacagaggttccggtggagacgtggctcccaggccacacgtgtaagtagcgcagctgggagtggcgcccggagcagcccgaacccaaaggctgatcttgaccgcggtgccctgctccttcccggccrcggtctccactcggcccactgctgggccagggccgcagcggccggaaggggctgtccctcatgcaccgtggccctccggccttgtctctcagcgcccagaccccaggcacaaggaggcagggggctgggacctgcctggagcctgctgccccagctgctgacgtggtcgcccccgcccaccctgtagacgtggccgcccccaccctgccacgtcgccacttccaccctgcaggcaggaagctgcacgctctcgctctctttgtgtaacttttggagggttgtagttgcaggaaacatctg

SEQ ID NO: 80777 - DNA, 601 bp, Human
ctgcctgtgcctcaggaaaccctgggcctccttcaaggcccttcccctgtaagcccctccgtgtcgggctctgctgtgtcttccgagaccacacctgtcctaggtgcctgggtccaggtgaggcgctccctgctgccagcagtggacagagactggttttaattaaagctcccagcaaccacccctatcgccgtggaaacagaggttccggtggagacgtggctcccaggccacacgtgtaagtagcgcagctgggagtggcgcccggagcagcccgaacccaaaggctgatcttgaccgmggtgccctgctccttcccggccgcggtctccactcggcccactgctgggccagggccgcagcggccggaaggggctgtccctcatgcaccgtggccctccggccttgtctctcagcgcccagaccccaggcacaaggaggcagggggctgggacctgcctggagcctgctgccccagctgctgacgtggtcgcccccgcccaccctgtagacgtggccgcccccaccctgccacgtcgccacttccaccctgcaggcaggaagctgcacgctctcgctctctttgtgtaacttttggagg

SEQ ID NO: 80778 - DNA, 601 bp, Human
tgagacacagatattctgtctatagcacaactacacagcaatacagggaaaggcatcccaggctgggggaacagcatatacgaaggctcagaggcaggagagaactgaggtgtgcaaagagtaacacagagacacatggggagagaggctggtgatgaggcggggaccattggggctgagggttctccatgttgcccaggcagacatgtgctggaattgctggatgtatcgcccagacatccagcaattccagtgcttcttctcaatcccccttcgaatgcctctttcacctttcacaaaygtttcctcctgctcaggaggcttgcctggcctgtgtctttgctccctccttcccttccctctctccctccatcccttcctctgccttatagactcctccctgagaagaaggccagctcccagtcttcccagtcttcccctccctcaggcccaatccagcctgagcacggtctggatttagtctttaggcttggtcaagagtgtgtttgcaaacctcttcactccttgctggctagagcttcccatcttcttaaccaggtcccctgagactccaaggcaggcacccactggggctgatcac

SEQ ID NO: 80779 - DNA, 601 bp, Human
ggtggggttgccgatttggacagcatggcaggtggggcctccacgggaagccgacctgtcctagtccacttgggctgggtggctcacagacagcagcttattgctcatggtcctggaggctggaagtccaagatcaaggcacctgcggatttggtatctggcaagggcccattgctggttcagagctggctgcttctgtctgcatcctcacatggcagaagtgagcaaggcagttctcagagacttcttttataagggtgctcatcccactcatgagggcagagcctcccagaggtcccayctcccaacatcatcatcttggaggttaggatttcaatgcatgacttttgttgagacacagatattctgtctatagcacaactacacagcaatacagggaaaggcatcccaggctgggggaacagcatatacgaaggctcagaggcaggagagaactgaggtgtgcaaagagtaacacagagacacatggggagagaggctggtgatgaggcggggaccattggggctgagggttctccatgttgcccaggcagacatgtgctggaattgctggatgtatcgcccagacatccagcaattc

SEQ ID NO: 80780 - DNA, 601 bp, Human
gagagcgagagaccttccaggtgccgggctttgcagcctcattggccttttctactaaggtcctttctctgggtgcccagggacgtgggtggcttgcacagaagccatgacaagtgtgtgggtctactgaggacccagctgcagtgaagggcctgggagaaccggaggtgcatgtgctcagggagtctaacccagctgtggggcagaatgtcacagggctggtagtgagagtggaaggtggggtcacctggactgcaggtgcctggggccagccaactgcagactgtccagggaatagagrgccaaggtgtcagtgtcactggagggcatgtggtggcagggggccctgggtggggacacgtcaaaagggcaggacccaggaattttccagtaagtacaaacctagtgaactttgggtgcaacaaacaagctacttgagttacaaacaatatactttagagaaaagcaaacaatttgccaaaaaaccccaagtgaactaggagcaaatggaacatggattgagggggccatacagccatttgaccattctagttggtagcaggggctgctgacagcactgtgatgagaaggactctgaggc

SEQ ID NO: 80781 - DNA, 601 bp, Human
ggcacgatcttggcttactgtaacctccacttccagggttcaagtgattctcctgcctcagtctcctgagtagctgggattacaggcgcatgccaccatgcccagctttttttttttttttttgtattgttaatatagacaggatttcaccatgttggttaggctggtcttgaactcctgacttcaaatgatctgccagacttggcctcccaaagtgctgggattacaggcgtgagccaccacgcccggcccagtgaagtgacttttgaggctgactgcccccccaactccttccccctcrccccctcctacacttctaaggttggggtgcgagtcacttgaggatcctggcccaggtgtggagggggacgctgcttcccacagtgctcgctcacggcaggtaactgtggaagaaccgtagcccaggttcttcctggggggctggggggctgctggattccacctgagcaggcccaacacccacctgcccagcagcatcttctttgcaccactgcacggctgctgaacgcggccctcacgcccttctcacatctgcctggcccttaccggcgtagcaacgtccttcatctccaggggcttc

SEQ ID NO: 80782 - DNA, 601 bp, Human
ctgaagacctatcgtgagacattccagcagttagaaataaggacctagcttttccagagcgattccacgcctttgctaatccccacagtcagatgtgctagtggagacacacagaatgggggaacggggttggtgatgggaggaggccaatggggtgactttttttttttttttaaacagagttttgctctgccacccaggctggagtgcagtggcacgatcttggcttactgtaacctccacttccagggttcaagtgattctcctgcctcagtctcctgagtagctgggattacaggcrcatgccaccatgcccagctttttttttttttttttgtattgttaatatagacaggatttcaccatgttggttaggctggtcttgaactcctgacttcaaatgatctgccagacttggcctcccaaagtgctgggattacaggcgtgagccaccacgcccggcccagtgaagtgacttttgaggctgactgcccccccaactccttccccctcgccccctcctacacttctaaggttggggtgcgagtcacttgaggatcctggcccaggtgtggagggggacgctgcttcccacagtgct

SEQ ID NO: 80783 - DNA, 601 bp, Human
aagacactgtctcaaaaataaaaaagtcacagactgttgcctaagtccttatggaaaccaacctgcttactgaagacctatcgtgagacattccagcagttagaaataaggacctagcttttccagagcgattccacgcctttgctaatccccacagtcagatgtgctagtggagacacacagaatgggggaacggggttggtgatgggaggaggccaatggggtgactttttttttttttttaaacagagttttgctctgccacccaggctggagtgcagtggcacgatcttggcttacygtaacctccacttccagggttcaagtgattctcctgcctcagtctcctgagtagctgggattacaggcgcatgccaccatgcccagctttttttttttttttttgtattgttaatatagacaggatttcaccatgttggttaggctggtcttgaactcctgacttcaaatgatctgccagacttggcctcccaaagtgctgggattacaggcgtgagccaccacgcccggcccagtgaagtgacttttgaggctgactgcccccccaactccttccccctcgccccctcctacacttcta

SEQ ID NO: 80784 - DNA, 601 bp, Human
acttgagcctgggaggtcaaggcagcagtgagctatggtcgccctgatgcactccagcctgggcaacagagcaagacactgtctcaaaaataaaaaagtcacagactgttgcctaagtccttatggaaaccaacctgcttactgaagacctatcgtgagacattccagcagttagaaataaggacctagcttttccagagcgattccacgcctttgctaatccccacagtcagatgtgctagtggagacacacagaatgggggaacggggttggtgatgggaggaggccaatggggtgactttttttttttttttaaacagagttttgctctgccacccaggctggagtgcagtggcacgatcttggcttactgtaacctccacttccagggttcaagtgattctcctgcctcagtctcctgagtagctgggattacaggcgcatgccaccatgcccagctttttttttttttttttgtattgttaatatagacaggatttcaccatgttggttaggctggtcttgaactcctgacttcaaatgatctgccagacttggcctcccaaagtgctgggattacaggcgtgagccaccacgccc

SEQ ID NO: 80785 - DNA, 601 bp, Human
caaagggaggccaaggcaggaccaggtcccatcccaccacctcggttatggagctgattaggaacccgagtgtccccaaggacagatgccccggcgcctgctgcggcgtgaagcagccctgccccctgctggcgacgctgggacagcgcgggtcctccagtcccttcttgctcctccaggcctgtgggtgccacagtggcttccggcagtggggttgattactgtgagtcagaatcacctgggcgctccgccacccagccatacccctgctcactgcagcaagcggtccagtcaggagccrgcttcatcccagtttcaccaagatgcctcagcagtcagctgttcgggaagctgggcacacagccctactgggtgccaggtgggcttggcctgcagcaggagcagggtcagggaaggtgaggacagagcgccaaggagggaggggggcgggtcctgccctctctgagcctcagtttccccatctccccacctccaaagtgaggacaaactccccactttccagggctgttgtgaccagggccttggtcacccagaaaatgctttaggaggaagcagccacttcctcctttcttttggtgtg

SEQ ID NO: 80786 - DNA, 601 bp, Human
aactgagaggcaagggagggggcaggggctcaggcacctgcggtgggggcagggacacatggctcctggatgggcaccgctgagctccctgtgcttccgtccctgccatcagccagcagacagcatgatgggaggaagggcgcacgtggggaatggggcgcatcctgagagcacatcctgagagaacggggcagcccctgcactttgtgcaggcagtgcacactcagggcggaggaggggtcatcgctgtgcccaaggacagctgcacctgggtgaccagaggaggccagggaagtctcakgggcctcaggaggaaggggctggggcgtggagacatcgggaagggccacatagagccttcagcccagtcccctggattctcagatgggcacagccgccccctggcagggactcagacagcatcggggcgggcaggccattgagtctggcattttctacctgcctttctgcagcgagccccctctgtaaagatgcccggagggagcccgcagcccctgcagagctgtgtccccacacttcgcagaggccctgcgaggaaggagtttgcccaaagggaggccaaggcaggaccaggtcccat

SEQ ID NO: 80787 - DNA, 601 bp, Human
ccctgccagggcctcggctctgcccactgagaccaacctgggcttctccagaggggtccaagtgtgaatggaccccgagggagggcggagtccttgaagtggccacccgcttcctctgtgtcggcacagccctctgccgacctggcttgctgagtctggcccacccatgttctctgcatataatcttgcacacatgaagcacgtgggccccttccgtggtctggaaaaggggtcggccctggggcttcgggagctgggatgtggcctccctgctgagaggcctcccatcctgctgcacatstgcgcacatggctgagtgctgctgtgtgagacaccagcggttggaagctggctctgtgccctggtggccccctggactctgggcacagcctccacggacacccgtccttggggtgagagtgagccctcggagttctcaggccagagcgcagggacaaaaggggaaagctgaggtctgtggttgcaggacacggacccctcggggctctgggagaagcccaggaaggggaagcttcccgtaagttcccagggccttggtgcttgttttaataatggggcagggtgttactatgggacttcc

SEQ ID NO: 80788 - DNA, 601 bp, Human
cacacattcacacacgtgcatactcaaacacgggcacggacacgctcacatggaccctcgcacccattcatacgcatgcaaacaccacgtgctcacacagatgctttggcatgcacacccatgcagaactgctcccgtgcacacacccatcgctgcccttgcacacacccatgcatgctcccatgcacacacacccatacaggctcagttgcacacacccatacacgctcccgtgcacacacccatacacgctttcatatgcacatacatccatattcccatgcacacacacccatacacrctcccatgcacacacacccatacatgctcccgtgcacacacacactcatgaacatacacacttgcactcagccctggaaggatcgacagaacagtgggggtcttgggtgcggggctgagccagcctcccttggtggagtcaggaccccacaccaacattctccctcttcctgggaacggcggctgtgcggctgtgctctgaaactctgggccactccctgggcccccaaccatggctgaatggtgggtgccacaggagtctcgactcactttgccatcttaggagcccccctgggtccca

SEQ ID NO: 80789 - DNA, 601 bp, Human
gaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtgsagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgtt

SEQ ID NO: 80790 - DNA, 601 bp, Human
tcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccrggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagagg

SEQ ID NO: 80791 - DNA, 601 bp, Human
cggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccgggactgtgatgggcgattggccacttctcaataatcttcctgttktccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaa

SEQ ID NO: 80792 - DNA, 601 bp, Human
gggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaayggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagc

SEQ ID NO: 80793 - DNA, 601 bp, Human
gaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtaktctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatat

SEQ ID NO: 80794 - DNA, 601 bp, Human
ttgatatctttaaaagagagatgtagcttgcaatcactgaagtacatatgcaatgcagaaatttttcttccctcctcaccccagcttgtctgggggatgcttaaactgacagcgatagttattataatcagaagacccttaggagcaaatttattgtatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaatyttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaa

SEQ ID NO: 80795 - DNA, 601 bp, Human
tgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattakccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaact

SEQ ID NO: 80796 - DNA, 601 bp, Human
ctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcrgtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaa

SEQ ID NO: 80797 - DNA, 601 bp, Human
ctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtrtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactca

SEQ ID NO: 80798 - DNA, 601 bp, Human
gaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaaccatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtrtttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtg

SEQ ID NO: 80799 - DNA, 601 bp, Human
caggcgcagagagagcaggacgtcacagtgaccgagggcctggaagttcgctaatcccggaactggaccccgcccaaagccgccctcttgcctccactggttgtgcagccgccgctccagagccgtgcgaatggggccatgccgaccaaagcgccgatggatgtggcgcaggtagcgcgcccactgcaaggcccggcgcacggtggcggggtcccaggtgctgacgtaggtagtgcttgagaccgccagaagctcggaaaagcgatccaggtgctgcagaagggattccatgaggtgcgcraaggccctacttccgctttcaccttggagacggcgactctctgcgtactgattggaacatccgcgaaatgatacgcctctctgcaatgctattggtcgaaatgcatgtcaatctcccagcgtctttatccgtgttccttgactctgggcaacttaaaagccctaatacttttactttcgccacacaaagaggttcttcttagtggagggagagcagatgtagggcatcctaccgagaatttccggaaccacgtgcgagatgatgccagtcatgaacgtctccgcgcttcctttcgctttg

SEQ ID NO: 80800 - DNA, 601 bp, Human
caggaaagagataaaaggagaatcaaagagctgaaataatcaaatgtatgcactaccttggaaaccaagagagtagagagcttctagaagaagagaattaccaagagtataaaatgttaaagagagcccactaatataagaatatatttaaaagtttaagtctgcgggatgtggcagaatatgcatcatgggtgatttagcacagtttcagcagggtattgtgagtggaagccaagtgaaaattggtagaaggtgaaggtcaggtgatgaggtcagcaagtgtagactattctttaaagamatttggatgaggagggagaaaagactgggtggtaggtagaggaggaagtagagtctaagaataaatgtttttgagggtgagagaaacttgagcacatttctaggctaaaggagaagatgatgagtagagcaaggtcctggagttgatggtggaaggacagagtcaagagtggggtcaagagcacagagaggaaggcaacgttaccctctaagaccaggagaaaggaagtgcaaacggcactggccacaaataggtttataaagggaaaggaagctaaaggagaaaggacaataacaactt

SEQ ID NO: 80801 - DNA, 601 bp, Human
gggtgatttagcacagtttcagcagggtattgtgagtggaagccaagtgaaaattggtagaaggtgaaggtcaggtgatgaggtcagcaagtgtagactattctttaaagacatttggatgaggagggagaaaagactgggtggtaggtagaggaggaagtagagtctaagaataaatgtttttgagggtgagagaaacttgagcacatttctaggctaaaggagaagatgatgagtagagcaaggtcctggagttgatggtggaaggacagagtcaagagtggggtcaagagcacagagrggaaggcaacgttaccctctaagaccaggagaaaggaagtgcaaacggcactggccacaaataggtttataaagggaaaggaagctaaaggagaaaggacaataacaacttccgtgttctaaaaaatccaggtgggaggcaatgccacctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggct

SEQ ID NO: 80802 - DNA, 601 bp, Human
caaacggcactggccacaaataggtttataaagggaaaggaagctaaaggagaaaggacaataacaacttccgtgttctaaaaaatccaggtgggaggcaatgccacctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggctgcatatcatggaaagagcatttgagttcagcagtagaaaacytgagctctggatccagcttggacaccaatgagctatgtgtacttgaacaactcctccactgtctgggagttctcatgccagccaatccagaaatgtggcagggacgggcatggtggctcatgcctgtaatcccagcactttgggaggtcgaggcaggtggatcacctgaggtcaggagttcgagaccatcctggtcaacatggtgaaactctatctctactaaaaatattttaaaaattagtggggtgtggtggtgggtgcctgtaatcccagctactcaggaggctgaggcaggagaat

SEQ ID NO: 80803 - DNA, 601 bp, Human
cctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggctgcatatcatggaaagagcatttgagttcagcagtagaaaacctgagctctggatccagcttggacaccaatgagctatgtgtacttgaacaactcctccactgtctgggagttctcatgccagccaatccagaaatgtggcagggackggcatggtggctcatgcctgtaatcccagcactttgggaggtcgaggcaggtggatcacctgaggtcaggagttcgagaccatcctggtcaacatggtgaaactctatctctactaaaaatattttaaaaattagtggggtgtggtggtgggtgcctgtaatcccagctactcaggaggctgaggcaggagaattgcttgaacccaggagatggaggttgcagtgagccaacacggtgccactgcactccagcctgggcgacagagtgagactccgtctcaaaaaacaaaacaaaaaaaa

SEQ ID NO: 80804 - DNA, 601 bp, Human
gcacagtggctcatggctataatcccaacactttgggaggctagggagggaggatcatttgagcccaggagttcaagaccaacctgggcaaaatagggataccctgtgtctacaaaaactacgaaaattagccaggcatgttggcatgcacttatgccagctacttgggaggctgaagtgggaggattgcttgagcccaggagcttgaggctgcagtgagccatgatcacaccactgcacttcagcctgagtgacagagcaagaaaaaaaaaaaaagatgtctcaaaaaaaaaaaaaaaaactatgtcaatgatcagtgcaatctccttccctgaatccaatttagaatgaggggtctctgtcttctctcggtcttctgaccaggtggtcaggagaaaaactagttagaaacctctttaactgtttgtcttgccttttctcccatttgctcatttattcatttgcacattcattcaacaaataaagttcctaccatgttccagacactgcactggatactgttcaaaaataatcccgccctgcatgaggttctaagacagttcacttcttgtatttccattatactttgactcatgaccgc

SEQ ID NO: 80805 - DNA, 601 bp, Human
tttacaggtactttggcccagtcaatcaaaggtaggagaaatggcttctttctatactcagactcagaatattgacggaaatttggcttcctacaacagtagtcctacaggagcgaacagtttagaatgaatgaaatgacggggatagagaggtgatgtctctattgtcaaccaaatcagtgacctgacataacctgttccgggcagcttgcctgtagctaagcatttaactggtctcttacaggagaagcaggaccctagtagctagggacacatctcaaactgtgacccatgaaccagyaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccc

SEQ ID NO: 80806 - DNA, 601 bp, Human
gtaagatacttccctcaccctattgaaaaactacagccagtcctgtaaaattttgtttacctttgggtgggctccatggattcaagcaattcagcactgagttgaatgaaggggttggggagacagaggtgatcataaggtgagcagcagtgagaactggagcgcagtggagcatgaagagtatctagtcttccttctgttccagatacttcctggtagttagactacatgggcttccccaggaatcctgggggacttaagagcatcaagatgcattgagttttggcgcaaggatcttccyttgccctgccacccacagaggaaaagcctgctgccctccacagcggcattattgcagacaggcaggagaaaacgaaccaggaaaaacaactttcgcaacctgaaggtttgtctctccttttccctacagtgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctga

SEQ ID NO: 80807 - DNA, 601 bp, Human
gcgtggtggcgggtgcctgtagtcccagctactctggaggctgaggcaggagaatggcatgaacccgggaggcggagcttgcgtgagccgagatcgtgccactgcactccagcctgggcgacagagcaagactccgtctcaaaaaaaaaaaaaaaaaaaactattttaagtaaacccttacatacagaaaagtgaatcacaagcatacagctcaaaaaaaaaattcacagagcaaatacacccatgcagccagcacataatttaagaaagacaatattaccaatgccattgaagcccctcytgtggtcacttccagccactacccatcctcaagagtgagcattgtcctgacttctaacaacaaggattaactttgcttgtttttgtcctttatgtaaatggactcatatactaagtattcttgtgagtagcttctttcactcaacaacatgtttatgtgctttatccatactcttgtgtatatataaaactcttattgttatttagtattccattttgtgaatataacccaatttattatgcattctaccttgtgtggattctgtttcttttttgtgcagcttcagacaagcagactctg

SEQ ID NO: 80808 - DNA, 601 bp, Human
tttgtgcagcttcagacaagcagactctgttgcccaatgaccagctctaccaggtaaggggatgaagaataaaagagacattgctgtaattagtgggggtaaatctttgggattgaggggcatgttatttggaagatcctatacaggtaagaaactgctaacagcataccagatgatgagatcagtttgggtagaataaatgaactaaagagaaggattgacagagactgaggtcaggatctagtgagcacaagttgaagaacacactgagagggacacacgaagaaactctcgacaggcygggcactcactatagacaggccatggctcatgcctgtaatcccagcactttgggaagccaaaacaggtgaatcacctgaggtcaggaattcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaa

SEQ ID NO: 80809 - DNA, 601 bp, Human
tttcttggtcccagcagcggttgctggcttctttaccttcttaggagtctttttgatgcttttcttcggggtagcggcgccagccaccttcttgggcttcttggctgccccagcaggcttcctaggcttggctgcgccagcctttttggccttgggtttgccttccccggaagccgctttcttgttgagtttgaaggagccagaagcaccggtacctttggtctgcaccagagtacctttgctcaccaagctcttgaggccaagcttgatacggctgttgtttttttctacatcgtagccrgcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatggtaggagcaagtggagcagtctccgacatgtttttgtcttcccagaaaagacaataagtaatctcaaactgtcagaacagcatgtcctctacgagggaggctgagggtttatatagagag

SEQ ID NO: 80810 - DNA, 601 bp, Human
ggccttagctggactcttggcagctttttttggctgaggtgttttcacctttttcgcactcttggccactttcttggtcccagcagcggttgctggcttctttaccttcttaggagtctttttgatgcttttcttcggggtagcggcgccagccaccttcttgggcttcttggctgccccagcaggcttcctaggcttggctgcgccagcctttttggccttgggtttgccttccccggaagccgctttcttgttgagtttgaaggagccagaagcaccggtacctttggtctgcaccagrgtacctttgctcaccaagctcttgaggccaagcttgatacggctgttgtttttttctacatcgtagccagcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatggtaggagcaagtggagcagtctccgacatgtttttgtcttcccagaaaaga

SEQ ID NO: 80811 - DNA, 515 bp, Human
tttacaggacaggtgaggcccgcaggaggaaaagcactcccctggcgcaacatgactccagcgcatctgcgtctaagccacaccgtgctcctggtagattaaaaattaattctaaaaaaaaaatctctcctatcccaaatgcactgttttctgccttgcttgacaattgatttgtttttaaaggaaagttatgggtagatcctcttttttctttcccattctttttttcttcttttatactggagggagggaaacggaggcgaggaccacacacgcgcaggcagaggctgaaaaggcccgaggtgggttttcctgtttaatatcaaaggaggccgaataatgggtttcctcggtccggctaggccggcctttgactcaattggaaatgcaaaggcagcttttgcctattctctggctgctggctgagaccctaaatttccgtaggaaatcgtcggacatgcacttaatcggtctttgcaatctttccctcgaagttgcacgcgggtctgggcgga

SEQ ID NO: 80812 - DNA, 601 bp, Human
acacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggygaagtaatgacaatgttttatcctgctggccactcatttattctcattctggggaacagtaagctgaagcagacatttgtagtgatgctccggtgtgagtctggtcatctgaagcctggatccaagggacccattttctcttagagtaacagagggcatggggtggagcccttgagccttttggcctggctcaagactacaggactcttcctgaccttcctatgttaccagttccataacatcagtaggagagaaacactgactgctttgcccctggtccctgggcacttgttccaaggt

SEQ ID NO: 80813 - DNA, 601 bp, Human
aagactgcgagtcctgaaaaatgtgactactgtactcttttgtataagcattaccggactcctgttgggctctctgagccttctcctcactgtggttttggttctcaacctctgacactacatttgacacagaaattgggaaggaaaaattaccttggtccttacattgccctgccatggtaactttattgggaggtatacagtcatagtcctcagagcccatgttgtgagcccaagattgtgaatcattaacagaagttttaaagcaaggggtatccaaaccattagtaagaacagcacratcaccagggacaacttctgaggaggaggcagaattagatggtgtcgattttatttctgaattaacattatctgaactcttctcaaattgcaaaacctcatttaagcctgcagtactactctgttctcccatactttcttctctcctcatcagtcttgggtctttgatggattttgaagtagtgactgtgcttgagccagtattgttgtgaagaggaaaagaagcattaagaccacttaaaatatttttaagacttgtccaatttaacaaaaggtcaccattaacactgtctttggcatc

SEQ ID NO: 80814 - DNA, 601 bp, Human
tccaactcataattctcagtgacatttgtttcattcccatctgtatggaggcaattacctgaagagcactgttctgtctttagaagctctttttctctacagctctgctcacagtgtggtacagtactggatgctgcaaaagaatctacagtaagaattctctgcttatccaagtaagattttgaagattctccctcactatctgtcactgcagcggctgataactgaggaatactgtactttttacttgctatcaaagttaggtttaatgggcccataaggaagtttcctgtaataatgytttgtttgggtctctcaataggatctgtccactttacttccaggtttcttttacaatcagataaaataaggttaccttgttggtagagatcatttaaaaagtgcttcacatttgaatctaagactgatataagtacgtcagttttcgcctttgtgtgacctatgcaagttgcatcacaatcgttgcctgtactagaatttatgttttcttttatgcaacttaaagatacagaattactttcatttattacttcattagcgtcacaactgttttctttagttgcatctttaacattatgat

SEQ ID NO: 80815 - DNA, 601 bp, Human
gcagagaactatcactggaagataattccactatattttccccataacttttatcttcttcagttcctgatgctacatccaactcataattctcagtgacatttgtttcattcccatctgtatggaggcaattacctgaagagcactgttctgtctttagaagctctttttctctacagctctgctcacagtgtggtacagtactggatgctgcaaaagaatctacagtaagaattctctgcttatccaagtaagattttgaagattctccctcactatctgtcactgcagcggctgatamctgaggaatactgtactttttacttgctatcaaagttaggtttaatgggcccataaggaagtttcctgtaataatgttttgtttgggtctctcaataggatctgtccactttacttccaggtttcttttacaatcagataaaataaggttaccttgttggtagagatcatttaaaaagtgcttcacatttgaatctaagactgatataagtacgtcagttttcgcctttgtgtgacctatgcaagttgcatcacaatcgttgcctgtactagaatttatgttttcttttatgcaacttaa

SEQ ID NO: 80816 - DNA, 601 bp, Human
tggtgctttatgaaattcttaaattgtatgaggaaatattatgttgagaagggaaaagtagtactatttctctgtagtcaagagaaattcttctttggcctggaattcacatatcccactcaacaaactaaaagccaaatatttcactgaattcagcctcactgaaacatcaccagaaatgcgataaaatcaaaattatactttctgagagctcaaagtatcgtatgggaattgatgactatgtaggttctcattaaaatgccagttttgaaatttgccattcttcaaaatgcacaagttaaaaaaaaaagtaatcttatcacttgtcctatttttaaaagtccctttttgattttagaagtctttttttggtaaaccacttactaagccccatcaattctttatgtattgtatcgtatcttgtaaagatataaatttttctttcttattctgtgaaacaatcacccttttctaagccttggctgacttacttctaactatactcagaatattcttaacctttacatcactgaaaaagcaaatttcacatgactttagcctttaatacttacagaatgaagttcaaactccttaggctgaa

SEQ ID NO: 80817 - DNA, 601 bp, Human
acacatacacacatatgtatgtgtatgtgtgtatatatataaaaacatatatatatatatgaatttttttttgacacagagtctcactctgttgcccaggctggagtgcagcagcaccatctcagctcactgcaacctccgcctcccaagttcaaatgattctcctgcctcagcctcccaagtagctgggactacaggcacccgccactatgcccggctagtttctatatttttagtagagatagtgtttcaccatgttggtcaggctgatctccaactcctgacctcaggtgatccgccygccttggcctcccaaagtgcagggattacaggcatgagccaccacacccagccagtaattagattttttggtgctttatgaaattcttaaattgtatgaggaaatattatgttgagaagggaaaagtagtactatttctctgtagtcaagagaaattcttctttggcctggaattcacatatcccactcaacaaactaaaagccaaatatttcactgaattcagcctcactgaaacatcaccagaaatgcgataaaatcaaaattatactttctgagagctcaaagtatcgtatgggaat

SEQ ID NO: 80818 - DNA, 601 bp, Human
atgttttgcctcaagtgagctgcccacctccacctcccaaagtgctgggattacaggtgctcagcctctactaaaaattaaaaataataaaaataaaaattaaaaattattaaaaataattagctggacatggtgatgcatgcctgtagttccagctacttgggatgctgaaatgggaggacagcttgagcccaagagtttgaggtttcagtaagctatgaatgtgccactggactccagtctaggtgacagaatgagaccctgccttaaaaaagaattatcttgcatttctccgtataasatattaaaagatggttatttttatttaaagtacattttatttccaatggtagaatatttggttgttagggtaactttttctgcaggataattgtttttatattttgctttaactctgataaatgcacatttcaatttcattaaaacacctatattctaatcatgctattttacaagtagaattaagcattttagaaagaaacaatttcatgttacagagcaaactatcaagttcttctaccaatacattttaattaactctattcacttacaccaagatactgtattagataactgagag

SEQ ID NO: 80819 - DNA, 601 bp, Human
gttcaagtgattctcatgcctcaccttcctgagtagctgggattacaggtgtgtactaccactcccagctaatttttgtatttttagtagataccagggtttcgccatgttttgcctcaagtgagctgcccacctccacctcccaaagtgctgggattacaggtgctcagcctctactaaaaattaaaaataataaaaataaaaattaaaaattattaaaaataattagctggacatggtgatgcatgcctgtagttccagctacttgggatgctgaaatgggaggacagcttgagcccargagtttgaggtttcagtaagctatgaatgtgccactggactccagtctaggtgacagaatgagaccctgccttaaaaaagaattatcttgcatttctccgtataagatattaaaagatggttatttttatttaaagtacattttatttccaatggtagaatatttggttgttagggtaactttttctgcaggataattgtttttatattttgctttaactctgataaatgcacatttcaatttcattaaaacacctatattctaatcatgctattttacaagtagaattaagcattttag

SEQ ID NO: 80820 - DNA, 601 bp, Human
tatttgagagccatagctggacttgattccagagctatcttttttaatatcacaaatagcttaactattaagaacaaaagaaagcccaaactatgagaacccttctgaaacaattacaatcaagatttcctatctcagaaattaaagtgtccactttaattcataggtttgtcccatctactatgcttggtgtttatcattacagcatcagcaatgataccaaattaataaaaaaggaaaaagcagagtcatggactttgttcctgctttctttttccccttttattatttttttgagacrgagtttaaccttgtcgcccagtatggagtgcaatggcgtgatctcggctcactgcaacctccgcctcccagatccaagccattctgctgcctcagcctcccatgtagctgggattacaggcatgtgccaccacacctggctaattttgtatttttagtagagatagggttgcgccatgttgtccaggctggtctcaaactcctgacctcaagtgatctgcctgccttggcctcccagagtgctgggattacaggcatgagctactgcgtccagccttttttccccttttatcgttttcct

SEQ ID NO: 80821 - DNA, 601 bp, Human
gatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccrtcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtgggg

SEQ ID NO: 80822 - DNA, 601 bp, Human
ggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgccygccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtc

SEQ ID NO: 80823 - DNA, 601 bp, Human
caagctttatcaaggagccccttcccaggtgtggcctggccgggagggtcctgccccctcttctggcctctcagctcctccccagcccaggctcctcttgggttagccccaactcctgccggacccctatgttgggctggacactcccagccctgggtgaggggcaggaggaggagggggagcccagcctgacccctcgggcagacttcgaggccccgaaagtgggggtgctgggctgtgatccgggcaccagaacagagccctcgaggcccacagaggtccctggctgcatctccagggrtcagggagtatgtgcccctgaggggaggggagctggaggggtcctgctgcctcctgcccggctccatctccagcgccccctccacctcgtcctgggcactgccctgtgtgtccaccccgccggcccacctcgaggagagtgtgggggacagtgcagccgtgctggggcgtggggggcgctcaaagggagggtgaaccctgtggtcagcacacaagcagggaccctgtggagggttttgctgtgttgtgggcttgtccctcaggtccacgaggaagggagtgaggccccctcacacgggag

SEQ ID NO: 80824 - DNA, 601 bp, Human
ctgaggggaggggagctggaggggtcctgctgcctcctgcccggctccatctccagcgccccctccacctcgtcctgggcactgccctgtgtgtccaccccgccggcccacctcgaggagagtgtgggggacagtgcagccgtgctggggcgtggggggcgctcaaagggagggtgaaccctgtggtcagcacacaagcagggaccctgtggagggttttgctgtgttgtgggcttgtccctcaggtccacgaggaagggagtgaggccccctcacacgggagggccggggtggggtaggsaggctcccttgctgcagctgccaagagtgagcgagcggggcttgggcttgggctgcccgggacactgcctccaggaagccccctgggctgtctcagtgggactctgtgagtgacacatggagctcaggtcacaagggctgtgggagtgtcaccccacaacagcaacgggtgcctggccctctggactttgctctctacacccctcctgagctctcacaaaccctggcccctgggaccggaggcaggtgatgtttccaaggagtcctacaggcaagcatcctctgacctgggagctgcgta

SEQ ID NO: 80825 - DNA, 601 bp, Human
cctcctgcccggctccatctccagcgccccctccacctcgtcctgggcactgccctgtgtgtccaccccgccggcccacctcgaggagagtgtgggggacagtgcagccgtgctggggcgtggggggcgctcaaagggagggtgaaccctgtggtcagcacacaagcagggaccctgtggagggttttgctgtgttgtgggcttgtccctcaggtccacgaggaagggagtgaggccccctcacacgggagggccggggtggggtagggaggctcccttgctgcagctgccaagagtgagsgagcggggcttgggcttgggctgcccgggacactgcctccaggaagccccctgggctgtctcagtgggactctgtgagtgacacatggagctcaggtcacaagggctgtgggagtgtcaccccacaacagcaacgggtgcctggccctctggactttgctctctacacccctcctgagctctcacaaaccctggcccctgggaccggaggcaggtgatgtttccaaggagtcctacaggcaagcatcctctgacctgggagctgcgtattgttcccgtttacaggtgagaaactgaggcc

SEQ ID NO: 80826 - DNA, 601 bp, Human
tgggaggtggaggttgtggtgagctgagattgcaccactgtactccagcctgggcaacaagagcgaaactccatctaaaaaaaaaaaagaaaaggaaagaaatcaagtcttgaggcatcatcattgttatatcatgtgcaggtgtctagcctggatgccacccagctatgccaaatgcggggagaaactccctatgggcactgtggctgggtccagagctcagaggctggagctttgagaactgggctggagccaaaccatgatggaagcctctagctctcaggaagagacacacatctgygggggcagagtgaccacatttccaggttgcccagccctcgggagtagcacagtgcccaggcactggggcagaggtggatcccgtagtccctcggtgggagctccaaagcctcccgttttcatctcttcctcttcccaggatgggattttggggatgagatcttcctggtgggctggagtctgtcccagaagtcaacagcccaacctggggccaaaaaagaccctcttagataaggcaggccctcggcaagactccagccacacatgagagggtggaacagagctcctgagtcccactaac

SEQ ID NO: 80827 - DNA, 601 bp, Human
gttgtttttagccttccgtgggggctctgcagccttgggatttggtggaggtgtttgttctgaggccgtttttctttgatgccaagatgtccccccgggcacttcactgcgtaagtgctatggtgtgatggagtgatgatggtggcgcactcttcaagctctggatcaggttccggaagctctgtgtgagtcttactgaggtggttattttctcttttccctggaaagtgggctgagagcactccatgtgggcacgagcggccctggctctgcaggactggagggggctgtgctggagggyggggggctggccaggcagccttggatcttgtcctcaggagcccttcaaaggggcagcagagactccaggccctgtgccccgaggagtcaggctgggctggttctggggagtgtctggagcacctgatgctgagcacaggcgggcgtccgtggagtgcacgtgtctgagggtctctgaggggtttgcccttttcttcggagccacggtggccgtgagggatgcaggacattgggtgtggccctcgaggactggcctgtctggagcccactcccccgtgggtgaacgcggctcttggtggag

SEQ ID NO: 80828 - DNA, 601 bp, Human
aagctctggatcaggttccggaagctctgtgtgagtcttactgaggtggttattttctcttttccctggaaagtgggctgagagcactccatgtgggcacgagcggccctggctctgcaggactggagggggctgtgctggagggcggggggctggccaggcagccttggatcttgtcctcaggagcccttcaaaggggcagcagagactccaggccctgtgccccgaggagtcaggctgggctggttctggggagtgtctggagcacctgatgctgagcacaggcgggcgtccgtggagtgcacgtgtctgagggtctctgaggggtttgcccttttcttcggagccacggtggccgtgagggatgcaggacattgggtgtggccctcgaggactggcctgtctggagcccactcccccgtgggtgaacgcggctcttggtggagagcccagtttggggagaagggacggtcttgtcctgggaggtgtcagacaaagccgagcatgggactcacaggagacccccagtcaggccgtgtcagggtgaggctgggagtgagggtcctggaaagtccggcttctgggagagggcgctttggct

SEQ ID NO: 80829 - DNA, 601 bp, Human
agggccctctttgaacgactttgtaactagacatccaccccagccgtgaccccgtgacccagagacacccccaggcctgtgccaagccctgtggtgaagtggggctcccggcctctgaccggccggtcgggtaagtggggaccgagtccaggcccagccacacgcctcgtggccccatgcagaatgaaagctggggtccttgttgaaaacgatgaacgatccaaagctggcggcagcagggtgttgatcccagcagggttctcctgtggtagctgcacacccgctgggaccaggggctcakggcggccctgcaggtcagcacctttaacaaagggtgcagcaacccacgcctgtgagactccactttggagcacgtggtgggagtcccccagcggtgaacgcacgtggccgcctccacctgagtctccgggaagtccctccagtgggccttcatttcttggggttgggggggtggacagatccctaaacccatgtggggtctgtgtccaaagcccctgcatttctgggaacctttggctgggaacagccacgtgggtgacctcagctggcactgtctcacaagtccctgaattctagcatt

SEQ ID NO: 80830 - DNA, 601 bp, Human
atattggtcaggctggtctcgaactcccgacctcaggtgatccacccgcctaagcctctcaaagtgctgggattacaggcgtgagccactgcacccagctgggatttgatgtgtttatgtggttaaatctggcctggagaagacaccatgacttacaacagcccagtgaaaccttggaaggtcagagagctggaacaggagggagctagagggccctgggtctggccctgggctggggccctgctgggcgtgggtggcgtgcagcaggccgtgtgctgctgggcgtgggtggcgcgctacrggcttcgtgctgctgggcctgggtggcgtgctacgggcttgtgctgctgggtgtgggtggcgcgctacgggccttgtgctgctgggcctgggtggcgcgctacgggccgtgtgctgctgggcctgggtggcgcactacgggccttgtgctgctgggcgtgggtggcgtgcagcaggccgtgtgctgctgggcgtgggtggcgcgctatgggccgtgtgctgagggctgtgttggttgatctctgtgtcaggtccctgcaggcctcaggtgtcaggaactttctctttgggtcttagatga

SEQ ID NO: 80831 - DNA, 601 bp, Human
tccacccgcctaagcctctcaaagtgctgggattacaggcgtgagccactgcacccagctgggatttgatgtgtttatgtggttaaatctggcctggagaagacaccatgacttacaacagcccagtgaaaccttggaaggtcagagagctggaacaggagggagctagagggccctgggtctggccctgggctggggccctgctgggcgtgggtggcgtgcagcaggccgtgtgctgctgggcgtgggtggcgcgctacaggcttcgtgctgctgggcctgggtggcgtgctacgggctcgtgctgctgggtgtgggtggcgcgctacgggccttgtgctgctgggcctgggtggcgcgctacgggccgtgtgctgctgggcctgggtggcgcactacgggccttgtgctgctgggcgtgggtggcgtgcagcaggccgtgtgctgctgggcgtgggtggcgcgctatgggccgtgtgctgagggctgtgttggttgatctctgtgtcaggtccctgcaggcctcaggtgtcaggaactttctctttgggtcttagatgagattccagctggggagaggagaagcatgcttgtgtggtag

SEQ ID NO: 80832 - DNA, 601 bp, Human
aacaggagggagctagagggccctgggtctggccctgggctggggccctgctgggcgtgggtggcgtgcagcaggccgtgtgctgctgggcgtgggtggcgcgctacaggcttcgtgctgctgggcctgggtggcgtgctacgggcttgtgctgctgggtgtgggtggcgcgctacgggccttgtgctgctgggcctgggtggcgcgctacgggccgtgtgctgctgggcctgggtggcgcactacgggccttgtgctgctgggcgtgggtggcgtgcagcaggccgtgtgctgctgggcktgggtggcgcgctatgggccgtgtgctgagggctgtgttggttgatctctgtgtcaggtccctgcaggcctcaggtgtcaggaactttctctttgggtcttagatgagattccagctggggagaggagaagcatgcttgtgtggtagaaaagaagacagacttgttcagcacaagattttctcagacttctgaattgagatacttgggaaagaaacattcaagttgtgtgactcataatttttggcagaaacaagcacagagctttgggagcagggaggaaaccgaggcttcctcctcct

SEQ ID NO: 80833 - DNA, 601 bp, Human
ggccctgctgggcgtgggtggcgtgcagcaggccgtgtgctgctgggcgtgggtggcgcgctacaggcttcgtgctgctgggcctgggtggcgtgctacgggcttgtgctgctgggtgtgggtggcgcgctacgggccttgtgctgctgggcctgggtggcgcgctacgggccgtgtgctgctgggcctgggtggcgcactacgggccttgtgctgctgggcgtgggtggcgtgcagcaggccgtgtgctgctgggcgtgggtggcgcgctatgggccgtgtgctgagggctgtgttggtkgatctctgtgtcaggtccctgcaggcctcaggtgtcaggaactttctctttgggtcttagatgagattccagctggggagaggagaagcatgcttgtgtggtagaaaagaagacagacttgttcagcacaagattttctcagacttctgaattgagatacttgggaaagaaacattcaagttgtgtgactcataatttttggcagaaacaagcacagagctttgggagcagggaggaaaccgaggcttcctcctcctcagcctctccacaagactgcatcgaccctggcgctgccacaga

SEQ ID NO: 80834 - DNA, 601 bp, Human
gaggctgagaaccgctggtgcgttttgtgggaaacctgtgggaaacccagggggcccacagggtccacacccccccacgcatgagctcacacgcgtgcatacgtgatctcatgtttgcacacatgtgtccatgcagatgcatgctctcacgcacatgtgcccacacactcagcactcacaccccgtcctgcaggctcagccccactcctgagccacctgcctgggctttgggggcccagccggcatggggagccccaggctccagctggcctcgcttggctctgaaatctaggccaggatrcagaacccgcagtgcggccagtggagcccctggtactgtgcgcagcccccacctggcagccccttttcctgtcaaagcccctcccagcgtcctctccccaccaggcaagctacccgcttgaggcttaggacgttgcgccctcctgtgtccttgcccagcatccccggcctgcatctcaccaggcaccgccggccgcgccagggcccgagagggcagggtcaggcaccctggcactcagcccaggactgaagatgccagagggagcggtgggtaggtgggtgagtgagtgagattgggtcc

SEQ ID NO: 80835 - DNA, 601 bp, Human
ccccacctggcagccccttttcctgtcaaagcccctcccagcgtcctctccccaccaggcaagctacccgcttgaggcttaggacgttgcgccctcctgtgtccttgcccagcatccccggcctgcatctcaccaggcaccgccggccgcgccagggcccgagagggcagggtcaggcaccctggcactcagcccaggactgaagatgccagagggagcggtgggtaggtgggtgagtgagtgagattgggtccggacggaatgggcgcagagatccaggaaactcccctacatctgcggygtttctgtccttggcttctgggttttgtttttgatgaaaaggtgaagttcaaagaaagcaaagccatggtgccacctcggttggtccgagtcgggagatgaggccgcctggtgcttgcgtaaagctcccgggacttggggttgggggacttgacctgcagcccctcgaatctgcccgccctcccaggccttggatcgagccacacctgctgtggttctaaacccgtagccctcaggtggcccatcagctgcctcagatgagccaagtctgagggagcagcctccgcccagccgggtgctt

SEQ ID NO: 80836 - DNA, 601 bp, Human
ggcgatgactcagatggggtgagtgacatctggggcacgggtggggtctcccctcaatccctggcacgcggagttcagggccaaggtctatgacaggaaaagtcccaaaatataccacttggggcactgggaagctgcgataccatttctgtgctctcctgtagcacctcagagcccttccttgccctgaactttcccataaaaacaaatacaaagcatgatataaacaccagaaaccaccctccatggcagctggtgagacagaggatgtgaggcagctcagcaaagtgtgtgtgtgtggctgtgtctgtgtggtgtgtctctgtgtcttgtgtggtgtgtctctgtggtgtgtctgtcttgtgtgttgtgtgtggatgtgtgtgtgtctgtgtggtgtgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtg

SEQ ID NO: 80837 - DNA, 601 bp, Human
tgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtgtctgtgtgttgtgtggcgtgtgtgttggtggggtgtgtggaatcacgtggtacccaaggggagaatcccccagccccaggtgtgaggaacagcagggamttctcactcaggggcccagatcacaacatgccccacgtgaacatggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggacccacagcctcgctcctgggggcgtgggcaggagacgccgtggacgtggaccc

SEQ ID NO: 80838 - DNA, 601 bp, Human
ctgggtgttcactgtgcttctcttgcaggatttctgttggttttcatttttattttaagtaaaagttaagagggaaaaaggaaaagggacaaagcatgctgggtgataagaaggcattctggggggccagggtctcttgtaacaaattcaggaagcatctcccagacttcagctgtcattggcttagatggccacaccggcctcactgttgattttaaattctgtctccctgttgcctttgcctgggagctggagctcaggggagtgcggcctgaggctggggatctgacagtgtccagcygggctccaggactgaaagcgtttgggctgccggggccgtctggggtgccgagagcagagctggggccacccggggggcgtgaccgtggccacctctgcttctcttcccagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgt

SEQ ID NO: 80839 - DNA, 601 bp, Human
ttcactgtgcttctcttgcaggatttctgttggttttcatttttattttaagtaaaagttaagagggaaaaaggaaaagggacaaagcatgctgggtgataagaaggcattctggggggccagggtctcttgtaacaaattcaggaagcatctcccagacttcagctgtcattggcttagatggccacaccggcctcactgttgattttaaattctgtctccctgttgcctttgcctgggagctggagctcaggggagtgcggcctgaggctggggatctgacagtgtccagccgggctcyaggactgaaagcgtttgggctgccggggccgtctggggtgccgagagcagagctggggccacccggggggcgtgaccgtggccacctctgcttctcttcccagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgtgcccagc

SEQ ID NO: 80840 - DNA, 601 bp, Human
gttttcatttttattttaagtaaaagttaagagggaaaaaggaaaagggacaaagcatgctgggtgataagaaggcattctggggggccagggtctcttgtaacaaattcaggaagcatctcccagacttcagctgtcattggcttagatggccacaccggcctcactgttgattttaaattctgtctccctgttgcctttgcctgggagctggagctcaggggagtgcggcctgaggctggggatctgacagtgtccagccgggctccaggactgaaagcgtttgggctgccggggccgyctggggtgccgagagcagagctggggccacccggggggcgtgaccgtggccacctctgcttctcttcccagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgtgcccagcactcggtgccagcatgcgtccaccctgcgtgt

SEQ ID NO: 80841 - DNA, 601 bp, Human
gagaggctgcggccgacatgggagtgagctgagctgggatcggggcaggtcagcagcctccttaggcccaccgttgctcggggttggtgctggaaggtggtcagacgtgggaggcggagctgctcagacacagcccttgtgggtgtgaggaggctcctggcgcgggtgcgaggacatcgggggaaggcgtctgccgcctcgtggggacttggagcgtggggtgcatttccatgtagacactgtaggtggcgccggaggagtcatttcccatcactaatggcttctcttgcacacccagggsgaccccggtgaagacggaaagccggtgagtctgcttttctttctgacccctgtgttatctgtgatgtttgcttagaccccagggctttgttgccagtgacactctttttaaacgcgacccagtgaggagactgtacagcaaaaccattttgaaagtggaattttgtaaagaaaagatgagtgtaactgttgatgggaaatagcagttatgcatttgtgttgagacatttgggccacaactaccatgaagaaggaaaggaagtgagaaaaggcagagcttccaaacccttagagggaagac

SEQ ID NO: 80842 - DNA, 601 bp, Human
gagggttcaagttaaaaacagtctagaaggtctgaaaggacagggagggcatctcatggtgcccaccgaacggtcattaccgaccgcctggcaccccacagccaagctgcctgcgatgaggaccacggcagacaaaggacagtcggctggggggcggcacggggcccacccactgcaacagggtacacgcacgcgtgtgagtgtggggtgatgatccacggggcccacccacagggcacacacacgtgtgtatgtatgtgcatgtgtttgagtgtgtgaatgtgtgactgcgcgtgtgtgkgggggggtgaggatccacacgtacacataccacacatgcacacacagcacatatcacacaccacacattacacaccacacgtggacacatgcacacacattacacacatgtgtgcacacaccacacattacaccacacgtggatacacttgcatacacacactacacacacgtgtgtgcacacacaccacaggtggacgcatgcacacatgctacacgcacgtgcacacatcacacgtggacacatgcacacacaccacacattacacataccacacgtggatacacacatacacatacc

SEQ ID NO: 80843 - DNA, 601 bp, Human
ctgaccagtgggggtgaccgcaagcaaggcctccgacctctctggccctgtgggtccacggactgcacagagagcgtctccatgagcaattcccatgggtgggtgtgggagggccgaggtcagcattgctggagggccaggggagggaggagcctgcttggccaacgcggctcgtagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcattcaccgtcaccatcggctctgaggcctctctgggtgccgcatggcaagtgctccccaggatccattctgaggggaatttgggcttaaagaacatgcctaatccatattcacgcatgt

SEQ ID NO: 80844 - DNA, 601 bp, Human
accagtgggggtgaccgcaagcaaggcctccgacctctctggccctgtgggtccacggactgcacagagagcgtctccatgagcaattcccatgggtgggtgtgggagggccgaggtcagcattgctggagggccaggggagggaggagcctgcttggccaacgcggctcgtagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcattcaccgtcaccatcggctctgaggcctctctgggtgccgcatggcaagtgctccccaggatccattctgaggggaatttgggcttaaagaacatgcctaatccatattcacgcatgtggc

SEQ ID NO: 80845 - DNA, 601 bp, Human
tagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctacygatgggcattcaccgtcaccatcggctctgaggcctctctgggtgccgcatggcaagtgctccccaggatccattctgaggggaatttgggcttaaagaacatgcctaatccatattcacgcatgtggccagactgcctctcagagggagcagcggctaccccagccctggtgtgcaagcatcttcccgccgtggtgctgtcggctctgccatctcatcctgccaatgtggccgcgaaactgcgggctacgcaggctgtggggtctcccgtgagccctgggactctggccctgtgtctgg

SEQ ID NO: 80846 - DNA, 601 bp, Human
caggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcrttcaccgtcaccatcggctctgaggcctctctgggtgccgcatggcaagtgctccccaggatccattctgaggggaatttgggcttaaagaacatgcctaatccatattcacgcatgtggccagactgcctctcagagggagcagcggctaccccagccctggtgtgcaagcatcttcccgccgtggtgctgtcggctctgccatctcatcctgccaatgtggccgcgaaactgcgggctacgcaggctgtggggtctcccgtgagccctgggactctggccctgtgtctggggaacgtt

SEQ ID NO: 80847 - DNA, 601 bp, Human
tccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcattcrccgtcaccatcggctctgaggcctctctgggtgccgcatggcaagtgctccccaggatccattctgaggggaatttgggcttaaagaacatgcctaatccatattcacgcatgtggccagactgcctctcagagggagcagcggctaccccagccctggtgtgcaagcatcttcccgccgtggtgctgtcggctctgccatctcatcctgccaatgtggccgcgaaactgcgggctacgcaggctgtggggtctcccgtgagccctgggactctggccctgtgtctggggaacgttctgt

SEQ ID NO: 80848 - DNA, 601 bp, Human
ctcatcctgccaatgtggccgcgaaactgcgggctacgcaggctgtggggtctcccgtgagccctgggactctggccctgtgtctggggaacgttctgtgtcctgccttctggaaacctgcggaagcccagataacctgttaacccagaaatcgttttagtggccgaatgccatcaagacccactatgctctgctctcccccagggacccccaggccctccgggaagagaggggcccccaggaaggactgggcagaaaggcagcctggtaagtcttccctcgagtccagggtgagtgggamccagcaccacaccatgtggcccgggtccgggggtgcctggtgacgcccgtgaaggggaaatgccaggaatagccccccatcacagccccacagcctggggcctcgcgctctggaggtcaccctgacctgggcggctggggcttgggtagaaattcataaccctgtgatgatgagtggactcacgggttttaagaacatgggcaccctgcgagatctgagatcttactccaagcttccacgttggttacggggcagtggccatgagcctctgtcggactgacgcaaggagccggggcccca

SEQ ID NO: 80849 - DNA, 601 bp, Human
cccccaggccctccgggaagagaggggcccccaggaaggactgggcagaaaggcagcctggtaagtcttccctcgagtccagggtgagtgggaaccagcaccacaccatgtggcccgggtccgggggtgcctggtgacgcccgtgaaggggaaatgccaggaatagccccccatcacagccccacagcctggggcctcgcgctctggaggtcaccctgacctgggcggctggggcttgggtagaaattcataaccctgtgatgatgagtggactcacgggttttaagaacatgggcacccygcgagatctgagatcttactccaagcttccacgttggttacggggcagtggccatgagcctctgtcggactgacgcaaggagccggggccccaggcgtttgtgggtggacctggcgggagtcgcctgcgtctggccccctggggagcggtctccagcatgacctcagatgagagctgcactgctttggactgagcaggggacgcgggctgtaaatgcccctcactgctctaagcctgtggctgagctgaagggcccttcttggggaggcatccaggccccaggccccacgtgtagccagg

SEQ ID NO: 80850 - DNA, 601 bp, Human
accagcaccacaccatgtggcccgggtccgggggtgcctggtgacgcccgtgaaggggaaatgccaggaatagccccccatcacagccccacagcctggggcctcgcgctctggaggtcaccctgacctgggcggctggggcttgggtagaaattcataaccctgtgatgatgagtggactcacgggttttaagaacatgggcaccctgcgagatctgagatcttactccaagcttccacgttggttacggggcagtggccatgagcctctgtcggactgacgcaaggagccggggccccrggcgtttgtgggtggacctggcgggagtcgcctgcgtctggccccctggggagcggtctccagcatgacctcagatgagagctgcactgctttggactgagcaggggacgcgggctgtaaatgcccctcactgctctaagcctgtggctgagctgaagggcccttcttggggaggcatccaggccccaggccccacgtgtagccaggtccagcattgggaccaggcttggcgtcccttgtggcttccctttcaggaccccaaccacaccagaaaggggggatgacagcggcaacagcctc

SEQ ID NO: 80851 - DNA, 601 bp, Human
gctctggaggtcaccctgacctgggcggctggggcttgggtagaaattcataaccctgtgatgatgagtggactcacgggttttaagaacatgggcaccctgcgagatctgagatcttactccaagcttccacgttggttacggggcagtggccatgagcctctgtcggactgacgcaaggagccggggccccaggcgtttgtgggtggacctggcgggagtcgcctgcgtctggccccctggggagcggtctccagcatgacctcagatgagagctgcactgctttggactgagcagggracgcgggctgtaaatgcccctcactgctctaagcctgtggctgagctgaagggcccttcttggggaggcatccaggccccaggccccacgtgtagccaggtccagcattgggaccaggcttggcgtcccttgtggcttccctttcaggaccccaaccacaccagaaaggggggatgacagcggcaacagcctcagaaactattaaaccggcacaggcagcaaagcagggacccgggtcggggcacagttcctggcagggcgatgtgccttcctctgtccactgtgctgcaagtctgattt

SEQ ID NO: 80852 - DNA, 601 bp, Human
tcaccctgacctgggcggctggggcttgggtagaaattcataaccctgtgatgatgagtggactcacgggttttaagaacatgggcaccctgcgagatctgagatcttactccaagcttccacgttggttacggggcagtggccatgagcctctgtcggactgacgcaaggagccggggccccaggcgtttgtgggtggacctggcgggagtcgcctgcgtctggccccctggggagcggtctccagcatgacctcagatgagagctgcactgctttggactgagcaggggacgcgggctrtaaatgcccctcactgctctaagcctgtggctgagctgaagggcccttcttggggaggcatccaggccccaggccccacgtgtagccaggtccagcattgggaccaggcttggcgtcccttgtggcttccctttcaggaccccaaccacaccagaaaggggggatgacagcggcaacagcctcagaaactattaaaccggcacaggcagcaaagcagggacccgggtcggggcacagttcctggcagggcgatgtgccttcctctgtccactgtgctgcaagtctgattttgtcataatc

SEQ ID NO: 80853 - DNA, 601 bp, Human
ctcactgctctaagcctgtggctgagctgaagggcccttcttggggaggcatccaggccccaggccccacgtgtagccaggtccagcattgggaccaggcttggcgtcccttgtggcttccctttcaggaccccaaccacaccagaaaggggggatgacagcggcaacagcctcagaaactattaaaccggcacaggcagcaaagcagggacccgggtcggggcacagttcctggcagggcgatgtgccttcctctgtccactgtgctgcaagtctgattttgtcataatcctgctcttttccgtacagggtgaagcaggcgccccaggacataaggtacaagcagaatccctggcacatcagtcccctgcccctggtgcccactcagtgctcggacccccaaagagggtggcagccccacggtcgagagagtgagctctcttggggctggccttgacccccactcctgccatctgtccatccgtcctgccggaatcgcgggcagcagcctctgtcactctggcgaggtggcttcggcccttgtcacttttgtgatgtggcttccgccgagctctggtctgccggtgaactgagagtagac

SEQ ID NO: 80854 - DNA, 601 bp, Human
gaaccctgcagaggaggggctgggagccgggtctgggcctccagtcggcatctgtgccgaccccaccacagacgcccccggaggtgccctcgaggatccaggcttccgtgggccgcccactcgaatcatgtccaaaacgtcaggagctcctcaccttggctggacggggttggcactaacggggaactttccccagaacatggccaagctccaggatgggggtgatgagggaaggaaggccagtggggagaggagtgaggaagaggacagctgcgagtcaggtggtgagagcacttggagrggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacaca

SEQ ID NO: 80855 - DNA, 601 bp, Human
gtcggcatctgtgccgaccccaccacagacgcccccggaggtgccctcgaggatccaggcttccgtgggccgcccactcgaatcatgtccaaaacgtcaggagctcctcaccttggctggacggggttggcactaacggggaactttccccagaacatggccaagctccaggatgggggtgatgagggaaggaaggccagtggggagaggagtgaggaagaggacagctgcgagtcaggtggtgagagcacttggagaggctgagaggacatgggctgggagtgaatgcatgtgcacatayacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtac

SEQ ID NO: 80856 - DNA, 601 bp, Human
ccactcgaatcatgtccaaaacgtcaggagctcctcaccttggctggacggggttggcactaacggggaactttccccagaacatggccaagctccaggatgggggtgatgagggaaggaaggccagtggggagaggagtgaggaagaggacagctgcgagtcaggtggtgagagcacttggagaggctgagaggacatgggctgggagtgaatgcatgtgcacatacacacacacacctctccagcatatgtacacatgcacacacacacctctccagcatatgtacacatgcacacacccctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacaca

SEQ ID NO: 80857 - DNA, 601 bp, Human
ctccaggatgggggtgatgagggaaggaaggccagtggggagaggagtgaggaagaggacagctgcgagtcaggtggtgagagcacttggagaggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacayacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgc

SEQ ID NO: 80858 - DNA, 601 bp, Human
ggggagaggagtgaggaagaggacagctgcgagtcaggtggtgagagcacttggagaggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacytctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacata

SEQ ID NO: 80859 - DNA, 601 bp, Human
gctgcgagtcaggtggtgagagcacttggagaggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacccctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatg

SEQ ID NO: 80860 - DNA, 601 bp, Human
gagagcacttggagaggctgagaggacatgggctgggagtgaatgcatgtgcacatacacacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtrcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacac

SEQ ID NO: 80861 - DNA, 601 bp, Human
acacacacacctctccagcatatgtacacatgcacacacacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacrcgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgc

SEQ ID NO: 80862 - DNA, 601 bp, Human
acacacctctccagcatatgtacacatgcacacacacctctccagcatatgtacacatgcacacacacacctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcac

SEQ ID NO: 80863 - DNA, 601 bp, Human
acctctccagcatatgtacacatgcacacacacctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtg

SEQ ID NO: 80864 - DNA, 601 bp, Human
ctctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggt

SEQ ID NO: 80865 - DNA, 601 bp, Human
ctccagcatatgtacacatgcacacacacacctctccagcatatgtacacacacacacacttctccagcatatgtacacacacacacctctccagcatatgtgcacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggtgt

SEQ ID NO: 80866 - DNA, 601 bp, Human
cacacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggtgtatatgtgcaacacatgtatctggggcatgtgcacacgcatctcttatgtgcacatacacacacatgtatctaggtatgtgcccacgtttttctagcacacatg

SEQ ID NO: 80867 - DNA, 601 bp, Human
cacgcacacacacctctccagcgtatgtacacacacacctctccagcatatgtacacgcgcacacacctctccagcatatgtgcacacacacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacatgcacctctccagcatatgtgcacatacacatagccagcacatgtgcacacagctctcatgtatgtgcacgtgtatctctagcatacatgcacacatgtatctggtgtatatgtgcaacacatgtatctggggcatgtgcacacgcatctcttatgtgcacatacacacacatgtatctaggtatgtgcccacgtttttctagcacacatgca

SEQ ID NO: 80868 - DNA, 601 bp, Human
acacataggcacacacatctccagcatatgtgcacacacacctctccagcatatgtgcacacacacacataggcacacacatctccagcatatgtgcacacacacacctccagcatacatgcacacacatgcacacacacatctccagcatatgtgcgcacacacatacacgcacacacacatctccagcatgtgtgtacacacacacacacctctccagcatatgtgagcacacacacacctctccagcatgtgtgcacacacatgcacgcctctccagcatatgtgcacacacacacaygcacctctccagcatatgtgcacatacacatagccagcacatgtgcacacagctctcatgtatgtgcacgtgtatctctagcatacatgcacacatgtatctggtgtatatgtgcaacacatgtatctggggcatgtgcacacgcatctcttatgtgcacatacacacacatgtatctaggtatgtgcccacgtttttctagcacacatgcacacacatctctctagcatatgtacacacacatgtatttgtagtgtgtgtgcacatctgtgtctctagtatgtgtgcatacacgtacac

SEQ ID NO: 80869 - DNA, 601 bp, Human
ggctggtctcgaactcctgccctcaggtgatccacctgcctcggcctcccaaagtgctgggattacaggcgtgagccaccacactcggcctaaacaaacttttttataggcactttttaaagatcaaaaattagatgaggctggacacgatggctcacacctgtaatcccagcactttgggaggctgaggtgggaggattatttgagtccaggagttcaaggctatagtaagctacaatcatgccactgtgctctagcctgggcaacagagcgagaccctgtgtccaaaaagaaaaaaaaattagatttttaaagacgataaaaggatgccaggcactaagacagattaaagccaagaaagtaaaatctaagattctcatgaagttagccctcaagttaagtgggtggtacatggtgcccacctgttaagacccagcgtagctgttggagggtggctgcagtggagacccagacctagaagggaggagacaggaggcagtcgaggatcaccttggcgggtggagggcggggaaagctctggcttggaggcccagcccctgtgggggacatgggaagcaggaaggacccttccccacagagg

SEQ ID NO: 80870 - DNA, 601 bp, Human
cactttgggaggctgaggtgggaggattatttgagtccaggagttcaaggctatagtaagctacaatcatgccactgtgctctagcctgggcaacagagcgagaccctgtgtccaaaaagaaaaaaaaattagatttttaaagacgataaaaggatgccaggcactaagacagattaaagccaagaaagtaaaatctaagattctcatgaagttagccctcaagttaagtgggtggtacatggtgcccacctgttaagacccagcgtagctgttggagggtggctgcagtggagacccagmcctagaagggaggagacaggaggcagtcgaggatcaccttggcgggtggagggcggggaaagctctggcttggaggcccagcccctgtgggggacatgggaagcaggaaggacccttccccacagagggggtttccttcctccagctgggcctgtgaccatatcaaggcagcgggtcacattcctgccccatttgtggacagtgctgggctcacactatctcattccgctctgtcccgagcctgggaaggaaccctgggcctctccgtctacagccacggaaaccgaggctcagggagct

SEQ ID NO: 80871 - DNA, 601 bp, Human
agtcgaggatcaccttggcgggtggagggcggggaaagctctggcttggaggcccagcccctgtgggggacatgggaagcaggaaggacccttccccacagagggggtttccttcctccagctgggcctgtgaccatatcaaggcagcgggtcacattcctgccccatttgtggacagtgctgggctcacactatctcattccgctctgtcccgagcctgggaaggaaccctgggcctctccgtctacagccacggaaaccgaggctcagggagcttgtggctgcgaggagaggggtggtkcagctgggccacgtcacagcgggacccctgcctcagggcctccctccctcacgccccccacaccgggctctcacctcacactccaggtggctggggccttgggtcaccgatggctccagcacatgcctccgggctcgcctgcttctcacggctttcggactaatagagtcaccgcaatgcctgtgtctaccctagccccagtggtcccagggtcctgagcctcctctcctctctcctctcttctccccttgcctgccggggagccagggctggtcccagggtcctgagcctcctctcctc

SEQ ID NO: 80872 - DNA, 601 bp, Human
acccctgcctcagggcctccctccctcacgccccccacaccgggctctcacctcacactccaggtggctggggccttgggtcaccgatggctccagcacatgcctccgggctcgcctgcttctcacggctttcggactaatagagtcaccgcaatgcctgtgtctaccctagccccagtggtcccagggtcctgagcctcctctcctctctcctctcttctccccttgcctgccggggagccagggctggtcccagggtcctgagcctcctctcctctctcctctcttctcccctcgcctsccggggagccagggctggtcccagggtcctgagcctcctctcctctctcctctcttctcccctcgcctgcccgggagccagggctggtcccagggtcctgagcctcctctcctctctcctctcttttcccctcgcctgcccgggagccagggctggtcccagggtcctgagcctcctctcctctctcctctcttctccccttgcctgcccgggagccagggctggaggtaacgagggtgccctgtgcacctcccgctgtgcatgtgggcctccccctgtgcatgtgggcccaaccccgac

SEQ ID NO: 80873 - DNA, 601 bp, Human
ggggccttgggtcaccgatggctccagcacatgcctccgggctcgcctgcttctcacggctttcggactaatagagtcaccgcaatgcctgtgtctaccctagccccagtggtcccagggtcctgagcctcctctcctctctcctctcttctccccttgcctgccggggagccagggctggtcccagggtcctgagcctcctctcctctctcctctcttctcccctcgcctgccggggagccagggctggtcccagggtcctgagcctcctctcctctctcctctcttctcccctcgcctgcccgggagccagggctggtcccagggtcctgagcctcctctcctctctcctctcttttcccctcgcctgcccgggagccagggctggtcccagggtcctgagcctcctctcctctctcctctcttctccccttgcctgcccgggagccagggctggaggtaacgagggtgccctgtgcacctcccgctgtgcatgtgggcctccccctgtgcatgtgggcccaaccccgaccaagttcgggctccgtggctctctcctcagttgtgtttctgtgtggctgaaatcgtgtcgtaaagttag

SEQ ID NO: 80874 - DNA, 601 bp, Human
ctcctctctcctctcttctccccttgcctgccggggagccagggctggtcccagggtcctgagcctcctctcctctctcctctcttctcccctcgcctgccggggagccagggctggtcccagggtcctgagcctcctctcctctctcctctcttctcccctcgcctgcccgggagccagggctggtcccagggtcctgagcctcctctcctctctcctctcttttcccctcgcctgcccgggagccagggctggtcccagggtcctgagcctcctctcctctctcctctcttctcccctygcctgcccgggagccagggctggaggtaacgagggtgccctgtgcacctcccgctgtgcatgtgggcctccccctgtgcatgtgggcccaaccccgaccaagttcgggctccgtggctctctcctcagttgtgtttctgtgtggctgaaatcgtgtcgtaaagttagaagaaaggctgctgtggggcctgcgttgcttggcagaatgttccttaccttttgatttgcagggtttagaaagcatcataagaaaacgtgtctacgctggggttgcagggccagcgggggctgggctgggtcc

SEQ ID NO: 80875 - DNA, 601 bp, Human
agggctggtcccagggtcctgagcctcctctcctctctcctctcttctcccctcgcctgccggggagccagggctggtcccagggtcctgagcctcctctcctctctcctctcttctcccctcgcctgcccgggagccagggctggtcccagggtcctgagcctcctctcctctctcctctcttttcccctcgcctgcccgggagccagggctggtcccagggtcctgagcctcctctcctctctcctctcttctccccttgcctgcccgggagccagggctggaggtaacgagggtgccstgtgcacctcccgctgtgcatgtgggcctccccctgtgcatgtgggcccaaccccgaccaagttcgggctccgtggctctctcctcagttgtgtttctgtgtggctgaaatcgtgtcgtaaagttagaagaaaggctgctgtggggcctgcgttgcttggcagaatgttccttaccttttgatttgcagggtttagaaagcatcataagaaaacgtgtctacgctggggttgcagggccagcgggggctgggctgggtcctgacacgctctcctcaccccacgcaggggagcaagggagc

SEQ ID NO: 80876 - DNA, 601 bp, Human
ctttctggggaaattcaagtcatcacattctttttgtggccccaatttttggtagtaacaaatgtttggcctgagtagaatctgaaattcctatgaaatctccactttcttctactgttaacatgtatactgctcagggttagagccagcaaggagtgaccaaaatcccaaaacaactgtgctcagacagctcagacgtgccaggggcagacccaggggccacaagctccttcctcccctgcccccactgtcccctccacaccaccagcgctctcgtggcgccagcatggaggagcccccrgggccacagccctgcccaagagacacgtggggtggctgaagccacagcgtccagcttcatgctcagagactcagcctgttgagagcacgggtggctgggacacatttcttacttggagcaaaacgaatgagaaatttcaattaggcagaaactaattgattccatagtaagttagaatggctttaccattttaacttagtacatttccttttacacacgtattttgaagtcttgactgttactagcgggcttttcttgcggcagacgcatctcacagcagggcctccagctgcactaaca

SEQ ID NO: 80877 - DNA, 601 bp, Human
gcgtccagcttcatgctcagagactcagcctgttgagagcacgggtggctgggacacatttcttacttggagcaaaacgaatgagaaatttcaattaggcagaaactaattgattccatagtaagttagaatggctttaccattttaacttagtacatttccttttacacacgtattttgaagtcttgactgttactagcgggcttttcttgcggcagacgcatctcacagcagggcctccagctgcactaacactgtgtctcctctgccctgacagggacctcccggcctgccgggactyaaggtcagtgacggatatgtctgggtttctgtggttgctggcttggccctgtctcgacatcttggggctgggggagacagggccttgcctcgggttttctgatggcaggagtaggatgaattcatcctgggaagtttgcaaaatacagcaaaaaagcctgacagggaaataatcgcacaccaaccccaacctagacttccagcgttaaggggccattgtcccgttctctctccgaagcccaggaatcaagattcctgggttcacacacctgaagcatattctcagacttgggccgaaaag

SEQ ID NO: 80878 - DNA, 601 bp, Human
aggggccattgtcccgttctctctccgaagcccaggaatcaagattcctgggttcacacacctgaagcatattctcagacttgggccgaaaagaggggcataggggaagaactcagggtccccacctcagcctcagggacaggtggactcctgggctcagggacagagccgtggtgaccttgtaggacccaggagctttgtcctctgctccccccatccctgggggacactagcccccagcctggccccgaagaccccaccccacccaggccccgaagctcccagggcaggtgcctgagcrgggagcctggagcctcctctcctaggccctgggcagcagccgcctttcaccccgctgcgtgctcatcaaagcgtcctctgctgcgtgcggggccaagggcgcacggggcccaccctggggctgcactctcacgcgtcaccagcccctgccatggcacctgctcctttgagctttgctttcatttgcaagacatcgggacactcaaaaggctgacttatgggaagggccgtgtgtttgctttcttaaattgtttgaatgaggccgtctcagcggggttcctcttgcagtctgcagtcctag

SEQ ID NO: 80879 - DNA, 601 bp, Human
tccccggctcagtttttgggggactcggctgatgcagtgggaggtggggagtcgagccctattctatgcagccagcagctcccaggcctgggctccggaagcttctgactgcccagccctggctcggggggatgggaggccacctgtggcttgtaggggttcagggctcccgtgtaacaagtgtttccgtccacagggggagaagggagaccgaggtgatgcaggacagaaaggcgaaaggggggagcccgggggcggcggtttcttcggctccagcctgcccggcccccccggccccccmggcccacgtggctaccctgggattccagtaagtcccagcctgtgcaggcagagcccatgtcccaggggtctgggtgcaggagccgagggcaggtccagcccggccttcgacacccgcgaaggccggagctgcccctgcaagctcagcagccccgacatgtccctgtccccgtgtggggacgcagcaggccacatgggtgtgggtgcactgaccccggacaccccccgtccccctgcagcgttccatggcctgccctcctgctggggccacgtgcatccacctctgctcctgggccgggtc

SEQ ID NO: 80880 - DNA, 601 bp, Human
ccccccgccctccccgccaagccccacacctctgcatttggtcccagcaggtgaggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgggttctggacccgtggaagggccgaagccgcctcctggggcttaaggaaggcgagaggctcaggccccggacagggatgggagcaggtggcagccagcgcttsttaaactttcaaacttttggtaaagtttagtaaaatacttttgtgagcagttttgggtttaaagaaaagtgagctcaagcttctgaaagtggatgaacacatggcgtgtgaggggctcctggtgggtcatgtcacagtgaacgtttacaaagataaatgtcacctcacacacccgataataagacaaggcgcctgacgggacgaggcggcaggggggctcaggccctccagggccacgtgacgtccacagcacggccccggctggggggcaggctgtcccgtggctctgcaccccgcgtt

SEQ ID NO: 80881 - DNA, 601 bp, Human
gcacgaggttcccgagggctggctcatcttcgtggccgagcaggaggagctctacgtccgcgtgcagaacgggttccggaaggtccaggtgagcgctctgtgtgacgggttctggacccgtggaagggccgaagccgcctcctggggcttaaggaaggcgagaggctcaggccccggacagggatgggagcaggtggcagccagcgcttcttaaactttcaaacttttggtaaagtttagtaaaatacttttgtgagcagttttgggtttaaagaaaagtgagctcaagcttctgaaagtrgatgaacacatggcgtgtgaggggctcctggtgggtcatgtcacagtgaacgtttacaaagataaatgtcacctcacacacccgataataagacaaggcgcctgacgggacgaggcggcaggggggctcaggccctccagggccacgtgacgtccacagcacggccccggctggggggcaggctgtcccgtggctctgcaccccgcgttataaacaccaaggtgggatgaaatgcatcctctctgcttagcacgggccttgctcaccagcctggctcctcagacacacctgggattgccc

SEQ ID NO: 80882 - DNA, 601 bp, Human
tggactgggagggccgggtgctgggcagggagggcaccctcctgtgggctggcagggccgggtgctgggcagggagggcaccctgctgtggactgggagggccgggtgctgggcagggagcgtaccctggcacaggcttggaggggcaggtgctgggcagggagggcaccctcctgtgggctgggagggccaggtgctggggcgggagagtcgggtgctgggcagggagggcaccctggctcaggcccagccgcaggtcctgggtgaccctgctgctttcttccagctggaggcccggacrccactcccacgagggacggtaaggagccttttttctgttgagactggtgggtggtcaggacatgagggggtatgtgctgtcccctgtttgaggaacaacacgtggtcctttggagtcctggagctgaacatgtggctcaccatcagcccctgctgcagaaactggtgcaggacaccccactacctctgtctcagcgctggccccccagtacctccgtctcagctgctggcctcacgagggagcccctctcatccctcaactttcccagttgtgtctgccgctcattgccctcctcaaggt

SEQ ID NO: 80883 - DNA, 601 bp, Human
ttcagagcccagcccctctcacccagcccagaggaggacacagatggaggaggggcacccggagggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcrcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagc

SEQ ID NO: 80884 - DNA, 601 bp, Human
agggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgg

SEQ ID NO: 80885 - DNA, 601 bp, Human
taccccggagccccgcaccacagctcctacgtgcacctgcggccggcgcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccsctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgc

SEQ ID NO: 80886 - DNA, 601 bp, Human
catgaggcccccccgtggccccctgaccccccgctcccccggcagtgcccctcagagggtcccatgctgctggaccaagtgtccacacaggtgatagggctcacatacaagcctggaatcaggaaccgtcctttgggcctctagtgccatgcgggctggtggcccctctgccacagcacccatgtggctttattctgtggccccttttcgtgcactgggctgtggcttctgggtgccccggggagcacccacattccccagaaccaacagcagaggggtcagagacccagggctgggagcrggcggctgtggcctggcgttaggggacagggtcccctgccttagccaaggcctcttggggtctgcagaggctgcctggccaggcctggctcccccgcgcttgttccctggcaggacatgcccaggggctgcagaaccccaccccccaaaaaaacacacacccacacacacacatccacaacaccccacatccccacaccccccccaaacacccacacccatccacacccccacacaccacacacacatacacacaggtttctcttccaggacgagctgctgtttcccagctgggaggctc

SEQ ID NO: 80887 - DNA, 601 bp, Human
agggctcacatacaagcctggaatcaggaaccgtcctttgggcctctagtgccatgcgggctggtggcccctctgccacagcacccatgtggctttattctgtggccccttttcgtgcactgggctgtggcttctgggtgccccggggagcacccacattccccagaaccaacagcagaggggtcagagacccagggctgggagcaggcggctgtggcctggcgttaggggacagggtcccctgccttagccaaggcctcttggggtctgcagaggctgcctggccaggcctggctccccygcgcttgttccctggcaggacatgcccaggggctgcagaaccccaccccccaaaaaaacacacacccacacacacacatccacaacaccccacatccccacaccccccccaaacacccacacccatccacacccccacacaccacacacacatacacacaggtttctcttccaggacgagctgctgtttcccagctgggaggctctgttctcaggctctgagggtccgctgaagcccggggcacgcatcttctcctttgacggcaaggacgtcctgaggcaccccacctggtaggttccc

SEQ ID NO: 80888 - DNA, 601 bp, Human
cttggggtctgcagaggctgcctggccaggcctggctcccccgcgcttgttccctggcaggacatgcccaggggctgcagaaccccaccccccaaaaaaacacacacccacacacacacatccacaacaccccacatccccacaccccccccaaacacccacacccatccacacccccacacaccacacacacatacacacaggtttctcttccaggacgagctgctgtttcccagctgggaggctctgttctcaggctctgagggtccgctgaagcccggggcacgcatcttctcctttracggcaaggacgtcctgaggcaccccacctggtaggttcccagtgccgtgtgagcagctctgagagccccagccagggaaggcgggcgggcgggctcctatctgcagtttccccccgagtttttggacaaatcttatacatgctcattactttaaaattacaaaatccaaaagagcattgagaaaaatgagaactgctctgagaagtcatcattagcaatgcgtttgagagccaggtagttgtaagaaggccccgaaggtgcccccggccctctgctcatggcggatagactccatgtct

SEQ ID NO: 80889 - DNA, 601 bp, Human
gctcatggcggatagactccatgtctcccggatgtcaccaagcctgtggtcagccatgtaagcagcgcagcgagtttattcaccgagaataaactcctcaaagggcaacacggagtccgagcatgtgtgcccttaaaatgttgacagaaatttccagggtatctagaagaacgcttcgtcccaaatgtcgctgtgccctccccacgtgagcgccgcgattcttccaacactcatgcatttaggggtgtctcggggtgccacacagcgtgtccccagcagtgcctggccatctgctgtaacrgagatgcacctgccaagggtctctgacaggagtgctgtgggcagggctgggccccagggaaggcctgaaagccaggagcccgggaggcggagctggttcctagcgaggcagccacaggaagcctctgctcagcaggcatgagggccaggttcacccagccaggccaagccctggcccctctcccctctgccgtgggtgtgtctggcagaagcagcatggggggcagtctgggagatgcagccccctccacaggcagccagcagggaggccatgtggccctccaggttgtgggagcctctg

SEQ ID NO: 80890 - DNA, 601 bp, Human
ctgtggtcagccatgtaagcagcgcagcgagtttattcaccgagaataaactcctcaaagggcaacacggagtccgagcatgtgtgcccttaaaatgttgacagaaatttccagggtatctagaagaacgcttcgtcccaaatgtcgctgtgccctccccacgtgagcgccgcgattcttccaacactcatgcatttaggggtgtctcggggtgccacacagcgtgtccccagcagtgcctggccatctgctgtaacggagatgcacctgccaagggtctctgacaggagtgctgtgggcrgggctgggccccagggaaggcctgaaagccaggagcccgggaggcggagctggttcctagcgaggcagccacaggaagcctctgctcagcaggcatgagggccaggttcacccagccaggccaagccctggcccctctcccctctgccgtgggtgtgtctggcagaagcagcatggggggcagtctgggagatgcagccccctccacaggcagccagcagggaggccatgtggccctccaggttgtgggagcctctgcagccccctggtaaccccagggctggcctcctgcctccacctt

SEQ ID NO: 80891 - DNA, 601 bp, Human
caggctctcaggacacccaaggccccacctcccacccggaaaagagacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatcccttgggccgctgggcaagcggcgagacctggccagggccagcgagccgaggacagagggcgcrcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcg

SEQ ID NO: 80892 - DNA, 601 bp, Human
tggctccaggcattctttgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgcyctaagtaggtagctccactacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgca

SEQ ID NO: 80893 - DNA, 601 bp, Human
tgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgctctaagtaggtagctccrctacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgcagcatttaacgtcatatg

SEQ ID NO: 80894 - DNA, 601 bp, Human
gtgagagggactgacacacagacatagactgaagtgcaggaaaacgcacactcagtgctgggaatgtaaacttgtccacttttaattgagaacaacttcactgcatctttcaaaattagaaacaacatacgacactggtatattttgcttttaggaatttatcccatacacttagatattcctgtggaagtagatacaagactatccactgcacagtttctgcggaaggatatttgtgccatgattttccttaagggatgccacaaagtcagagtccatctgtgcagtgaaatcacacacrgtcctagaggacggggtggacagtctcactacgatgtcaaaccacctctgagatcctccaggtgcacaaaccaagactcagggcagcctggacggacgctggtcagttccgtggagggggatgggcactggaggacagactttgctgtgcattttgaatttctgcccatgtgactgtatcatctgggcagaagtacttagatcgaaactactgggaaaacagaaagatcagacagaggaagtattcaggagatgcctgacaagaaacttgaaagtctggtcccaaaataaaaacgaacaa

SEQ ID NO: 80895 - DNA, 601 bp, Human
aacatgatgaggtagataataataatatctcttttgctaaatgaagaaacaaagcaaagttaagtgacttgcccaatgaccaacttttgtgcagtgtacattctggtccttggagaattatgaaaaataaatagcaatgtttataaacaagtaattataaaaatcacagcattacaaaggcttttcccattaataggtaatctttctttcttcatggtggtagacaacttcagaagggttgggtagctacagttctctgctggactaaaagaaaactgattgcttttattcagctttttttaaaaaaaaaaacaccttttaaatttgctactattttttcttctttctctctttcttcctgggtgacaatattttccctttcctgggtgatcattttccttctcagccaccatcaaattacacctattgttagtatactacaaaagatcttatatttaacaaattgtagtgatgtttcaaaatggtgtgctcttcacatacagagatcataccttcaaggagttcttcattagatgtttcgcctttcaagaggattttcatttttaagaaaagcccaggagaacttaaatgttcctatttt

SEQ ID NO: 80896 - DNA, 601 bp, Human
caacagtgtgttcaaaaactattatattaataaaacaatatcaggctttatgcaacaggaaagctgggaataaaatggttaagatgcaaggctttctggtctttctttttacttgatgagcctgaacaaattgcttccctgtatctcttatctgacttccaaggattctgatcttgacttcacaagcctgctgctgctctcctctcttcttcattttagtttggcaatgtcaatctgatctcccacattcttgttctgtatttttatttggtgcattgactttcctagatcactatctctrggtttctgattctatcttggtagtctaactgcaattcaagatccctttgtttatttgatttagtattcttgtcactggaataaacagtaactgattaagcttacctaatcagcatcaaaaaaaaaggggggcctgacgcctttcaccaataacaacataaatgacaaatgttaacattgtaactaggaaaaattatgcaccaatacgcataaggaattaaaggaaagaaaaaactaaaagcagattgttaggataataatattagatgtgatcttttttgttttaaatttttcattacag

SEQ ID NO: 80897 - DNA, 601 bp, Human
attatcataagaatgtatttcatttaaacatataattgtaaaattctgctacattcttaagtataattttatcatatcttagagccaaacattttttggaggtaaatcattttatttgtatagtgtaagtttatggaaaaataataccatatcaaattttctctgaacagaacttttcaggaactcatttaatgtgtagaatctagatagctctgaaatattttattataacattcaacagtgtgttcaaaaactattatattaataaaacaatatcaggctttatgcaacaggaaagctrggaataaaatggttaagatgcaaggctttctggtctttctttttacttgatgagcctgaacaaattgcttccctgtatctcttatctgacttccaaggattctgatcttgacttcacaagcctgctgctgctctcctctcttcttcattttagtttggcaatgtcaatctgatctcccacattcttgttctgtatttttatttggtgcattgactttcctagatcactatctctgggtttctgattctatcttggtagtctaactgcaattcaagatccctttgtttatttgatttagta

SEQ ID NO: 80898 - DNA, 601 bp, Human
aatcacaagaaaaatgcaaatcaaaaccacaatgagatactatctcacaccagtcagaatggctattattaaaaagtcagaaaacaacagatgctggagaggctgcaagaaaagggaacatttatacactattaatggaaatgtaaattagttcagccactgtggaaagcagtttggagattcctcagagaacttaaaacagagctaccattagacccagcaatcccattactgggtatatacccaaaggaaaacagattatacaaaaaaaacctcacatgcactcatatgttcatcactstgctattcacaatagcaaagacaaggaatcaacataggtgtccctcaatggtggattggataaagaagatgtggtacatatataccatggaatactatgcagtcataaaaagaatgaagtcatgttctttgcagcaacatggatgtaactggaggccataatcctaagcaaattaaaacaggaacagaaaaccaaataccacatgttctcacttataaatgggagctaaacattgagcacacatggacataaacatgggaataatagacaacggactagtagaggggggagaggtgaagg

SEQ ID NO: 80899 - DNA, 601 bp, Human
ggcaagtcagtcaaaactgtattaattctaatgccaaataggtaggcaagaggtagaatagttttgtcttcataaattatcctctaacccccccttttatggtataaaaatattctgtgattgtatttgtttcataattttgagcttatcttccccattaagtagtgatatccttgagaccaccagggacatgcatattattttatctctgcatcttcaatgcctagcaacaaaatgactggtacattgtaggaactcaaacgtgaaagaatgaatttccactgctatcaacctagtttcmggctcttattacttcatatttgagctacttacaacaactcaattaatctccctatctctcaaattcttgcatattattgctattagcatgtcactatcctatttggaaaccttcagtgggtccccatttgcctatatcatatagtcctttaacccagtatcaaggaatttaataaatgactccaatttacttctctaactttatatttcattatactccttatataaaacttatgctaaatcctctcggattcattagtcatcatattctaaatagaccatgttgtccccatatctactt

SEQ ID NO: 80900 - DNA, 601 bp, Human
tgcaaacaaaaagttcttgaaggcaattaaaagtactactccagtgaacacaaaaatgataaaaaagcaaaacagccttattgctaatatggacaaagttttagtggtctggatagaagatcaaccccagccacagcacgttcttgagccaaagcctaatccagagcaacgtcctaactctcttcattctatgaaggcctagagaggtgaggaagcttcagaagcaaaatttgaagctaccagaggttcgttcttgtggtttaaggaaagaagctgtctccgtaacataaaagcacaatgyaaagcagcaagttctgatgaagaagctgcggcaagttatccagaagatctaagatcactgatgaaggtggctacactaaataataaattttcaacatagatgaaacattcttacattggaagaagatgccatctagaactttatagctagagagaagtcaatacctggcttcaaagcttgaaaggtcaggctcactctcttgttagagactaatgcagctggtggctttaagttgaaaccaatgcttatttaccattccaaaaatcccagggcccttaagaattatgctaaatcttctct

SEQ ID NO: 80901 - DNA, 601 bp, Human
tggcaaccctgaatcaagcaagtcaagtctacaggtaccatttttccaacagcatgcactctatttgtgtctctctgtcacatttaagtaattctcgcaatatttcaatttttttcattattattataactgtaaccagtgatctttgatgtcaacattgtaattgttttggggtaccataaactaagcccaaatgtgtgtgttctaactgcttcattgactaattattccccatctctctccctttccttgggcacccctattccctgagacacagcaatactgaaactaggccaattamtaaccctacaatggcctctaagtgttcaagtacaaggaatattcacatatctctcattttaaatcaaaagccagtgatgattaagcttggtgaggaaggcatgttgaaagccaagctaggccgaaagctaggcctcttgtgccaaacagccaaattgcgactgcaaacaaaaagttcttgaaggcaattaaaagtactactccagtgaacacaaaaatgataaaaaagcaaaacagccttattgctaatatggacaaagttttagtggtctggatagaagatcaaccccagccacagcac

SEQ ID NO: 80902 - DNA, 601 bp, Human
aggcatgacacaaaatccacaagtcataaaaaaagaaggctgacaatttaatttcatcaaaactttgttaacttttacctttgaaataactatagatccacaggaaattgcaaaaaaaaaatgtataaggaaatcccatgtaccctcacccagtttcctcctatagttaaatcttatataactatagaacaatatcaaagcaggaaacagcattggtacgatgtgtgaacaggcatacttcattttattgcacttctctttattgtactttacagttactagttttttgtttgtttgtttttttttgaaacagggtctcactctgtcacccaggctggagtgaagtgctgtgatcatagctcactgccgtcttgatctcctggctcaagcctcctgagtagtctcagcctcccgagtagttagaactataagcacgtgccaccagatactgttctgtttgtttgttttacaaattgaagatgtgtggcaaccctgaatcaagcaagtcaagtctacaggtaccatttttccaacagcatgcactctatttgtgtctctctgtcacatttaagtaattctcgcaatatttcaatttttttca

SEQ ID NO: 80903 - DNA, 601 bp, Human
ttgagtacagttatttacctcaaaaaaatagaatgaatgtaagaataaatctatagtagagccagagagcaggaaaatatattgtctttggtaagaaactttaaagaatttctataattaaaagcaatcagactgatggaaaaatcaagaggtgagaatcctgaaacccaacagaagccaaaaaggaggccattgaagaaatagataggttccccccagcaaaaaaaaaaaacaccctaggaaactccacaaaattagaaattaattagtaggggacaggaaaaatttgtgatgatcctasaggaactgcagaaactattccaattctctgttgtgcatgcaaggagtagaggccattgatgtttgaccccaggctctgctgtcaaaccttctaaatgatttaagggatcagttatgggaacctcccagcttgagcataagggacaggaagactgtagatatgagaaaaggagtaaagaggaaaatcaatcagcacagtagtgaaaatccttatatggcaagagaactaatttcctactttgcatatcaagatggaggtgggggctagtgtctctagcccactgtaataactagtctctaa

SEQ ID NO: 80904 - DNA, 601 bp, Human
aaattattctatactggatgaatagttaatttttatttatttatttctgaagaagcttgtttagatttacattttatttttattttttattattataagtaaataatatgtacatttttataagtacatagtatgtacacacttatggggtacatacaatagtttgacacaagcatacagtgtgtaatgatcaattcagggtaattgggatacccaccacctcaagcatttatcatttctttttgttgtgaatgtcccaatttcacttttagttgttttgaaatatacaataaattattastaactatagtcaccctattgtgctactgaatgctagattttattccatctatctaaccttcagtttaaaacagcagattgagtacagttatttacctcaaaaaaatagaatgaatgtaagaataaatctatagtagagccagagagcaggaaaatatattgtctttggtaagaaactttaaagaatttctataattaaaagcaatcagactgatggaaaaatcaagaggtgagaatcctgaaacccaacagaagccaaaaaggaggccattgaagaaatagataggttccccccagcaaa

SEQ ID NO: 80905 - DNA, 601 bp, Human
aatcaccaaacacaggaagcaaccaagatgtcctccaataggtaaatagataaacaaagagatgagctatcagtcacaaaaaagacatagaggaacctgaaattcatattgctaagtggaagaagccaatctaaaaagactacatactgaatgattccaattatgtgacattgcagaaatggcacaaaagcaaaaagaagagccagtaagaaaaatagagagtgaaaagatgtggttgccagcatctcaggaagatgaagagatgaggcacagaggatttttaggatggtgaaaatactaygtgtgatactataatagcagatacgtgtcattatgcatgtcaaaatccacaggactttaccacacaacaagtcaatctcaatgcatacaaattatatatatagttatatataactaggtattatatatattatatataatttgatattttatatatatatatataatttgggaggttgggggaatcctcagatataatagagactgtgacaagagactctaacaaatgtgtggaacaacttcactaaaggaaataggaggactagatactgacctaagtaactctggaaataagtagagt

SEQ ID NO: 80906 - DNA, 601 bp, Human
aaaccaaacaccacatgttctcactcataagtgggagttgaacaatgagaacatatggagacagggaaaggaacaacacactctggagcctgtcgggaggtgagggtgaggggaaggagagcatcaagacaaatagctaatgcatgtggggcttaaaacctaggtgacaggttgataggtgcagcaaaccaccatggcacacatatacctatgtaacaaacctgcacgttctgcacatgtatccagaacttaaagtaaaaaaaaaaaaaaatacagaatgccccagtaaaattagaatttmagataaacaaaaattatttttttagtattagtgtgtccagtgcaatagctgggatgtgcttattctaaaatactagacattgtttatctgaaatttcaaattaaccgagtcttgtattttatctggcaactctattcatgaaacaccagttgcaagagatctcgccttaataaaaagagacccatagttttaaaaaaagaagtaccttatttatacataggtagacatccatttgcaagggttatgattagatcggtttactttgaatcaataagtatttccttaactctctgctacaca

SEQ ID NO: 80907 - DNA, 601 bp, Human
atcatctcagcaaactaacacaggaacagaaaaccaaacaccacatgttctcactcataagtgggagttgaacaatgagaacatatggagacagggaaaggaacaacacactctggagcctgtcgggaggtgagggtgaggggaaggagagcatcaagacaaatagctaatgcatgtggggcttaaaacctaggtgacaggttgataggtgcagcaaaccaccatggcacacatatacctatgtaacaaacctgcacgttctgcacatgtatccagaacttaaagtaaaaaaaaaaaaaaatacagaatgccccagtaaaattagaatttaagataaacaaaaattatttttttagtattagtgtgtccagtgcaatagctgggatgtgcttattctaaaatactagacattgtttatctgaaatttcaaattaaccgagtcttgtattttatctggcaactctattcatgaaacaccagttgcaagagatctcgccttaataaaaagagacccatagttttaaaaaaagaagtaccttatttatacataggtagacatccatttgcaagggttatgattagatcggtttactttgaatca

SEQ ID NO: 80908 - DNA, 601 bp, Human
gaccaatggaacagaatcgagagcccagaaaaaaaccccaaaaaaccaagtatatatagccaactagtatttgacaaaggtgcccaaaatacacaatggaaaaagcacagtctcttttgtgcttgggctgggtgcagtggctcactcctgtaatcccagcacttcagaaggccgaggttggtggatcgcttgaggccaggagtttgagaccagcctggccaatgtggcaaaaccccatctctactaaaaatacaaaaattagctggatgtggtggcacatgcctgtaattccagctatgcrgggagggctgaggcacaagaatcacttgaacccaggagacacaggttgcagtgagccaagatcatgccaccacactctagcttgggtgttggagtgagactctgtctcaaaaaaaaatgtgtttggacaactggacatccacctgcaaaagaataaattgaacacatcctacagcacacacacaaatcaacagaaagtgcattaaaaacttaaatgtaatacttgaaactgtagaactcctaaaagaaaaaaatagggaagaagctctttgaaattggccttggtaaggatttttttgta

SEQ ID NO: 80909 - DNA, 601 bp, Human
gcaaccttaaaaacaaaaacaaaattggaggcatcacgctttctgatttcaaattatactacaaagctatagtaatcaaagcagtatggtactggcataaaaacagacacatagaccaatggaacagaatcgagagcccagaaaaaaaccccaaaaaaccaagtatatatagccaactagtatttgacaaaggtgcccaaaatacacaatggaaaaagcacagtctcttttgtgcttgggctgggtgcagtggctcactcctgtaatcccagcacttcagaaggccgaggttggtggatcrcttgaggccaggagtttgagaccagcctggccaatgtggcaaaaccccatctctactaaaaatacaaaaattagctggatgtggtggcacatgcctgtaattccagctatgcggggagggctgaggcacaagaatcacttgaacccaggagacacaggttgcagtgagccaagatcatgccaccacactctagcttgggtgttggagtgagactctgtctcaaaaaaaaatgtgtttggacaactggacatccacctgcaaaagaataaattgaacacatcctacagcacacacacaaat

SEQ ID NO: 80910 - DNA, 601 bp, Human
accaaagaactctaagaactaataaattacttcagtaaagttgcaggttacaaaatcaacatacaaaacccagaagcgtttctttgtgccaacaataaaatatccaaaaaggaaatcaagaaaacaatcctatttacaatagcatcaaaaatatataaaatagttgggcacagtggctcatgcctgtaattccagcactttgagaggctgaggagggtggatcacttgaggtcaggagttcgagaccagactggccaacatggtgaaaccctgtctctgctaaaaatgcaaaaattaactrggcatggtggtgcatgcctgtaatctcagctactcaggaggctgaggcaggagaatcacttgaacccaggaggtggaggttgcagtgagccgagatctccagcctgggtgacagagtgagtgagactccatctcaaatatatatgaataaaagtaaccaagtaggtgaaacatctgtacactgaaaactaaaaaacattgatgaaattgaagaaaacaaaaataaaatagatatcctgtgttcattgattgaaagaattagtattattaaaatgtccacactactcaaagtgatctacaa

SEQ ID NO: 80911 - DNA, 601 bp, Human
attacaggcgtgagccaccacgcccggccaatgctcgctttatttcttatctcccagggaccattctccttcattgcctgatgttcagggtcataaaagcctttttttttcttttcgtctattttgtcttgtcctttgtggagaggggcttgttgttcaagaagggacataaaacagtccctgttactacatattaattgcaagtggaagcaaacacaactttttttttaatggtacgtcccatctgatttatatacacagggacacaaatgtataatacacaaagattagaaggaaatayaccaaaattataaatgattgttctttgctttaaaaaaacttatctttaggtttacaggaaacctgagttgtcttgtaaaggttttttttttccattttttattacaccattaagtttttaaagggaataaaactctttctcagccctcatgttaaaaaaattacattcttatatcttaatatcagcgatgacatttccctacactgtaagctctcaatggagaggaatcatgtcttattatttttaataaactcttgcacaatgctcattaacactctatattgtgaatatttaataaat

SEQ ID NO: 80912 - DNA, 601 bp, Human
gtcttataaattctggctgccttggtctcctcagactcagctgcatctcaaatcaggacgcttgccaggctctgcttcagatccccttcttgtgctataccctggaaactcaaagcagtaagctgcacaattgtaatgctcactttctttctttcttttctttccttttttttttttttttttttttgagatggagtcttgctctgtcgccaggctggagtgcagtggcgcgatctcggctcactgcaacctctgcctcccgggttcaagcgattcccctgcctcagcctcctgagtagckgacactacaggcgtgtgctaccatgcccagctaattttttgtattttagtagagatgggctttcaccatgttagccaggatgttctcgatctcctgaccttgtgatctgcccacctcagcctcccaaattgctgggattacaggcgtgagccaccacgcccggccaatgctcgctttatttcttatctcccagggaccattctccttcattgcctgatgttcagggtcataaaagcctttttttttcttttcgtctattttgtcttgtcctttgtggagaggggcttgttgttcaagaag

SEQ ID NO: 80913 - DNA, 601 bp, Human
agtcttttattcagtgtgtttaattttgaatagcttctttgctctgacttcaagtttatcaatcttttcttttacaatgcctaatctacgctatgtggtcctcttcagtactttgtcttataaattctggctgccttggtctcctcagactcagctgcatctcaaatcaggacgcttgccaggctctgcttcagatccccttcttgtgctataccctggaaactcaaagcagtaagctgcacaattgtaatgctcactttctttctttcttttctttccttttttttttttttttttttttgagatggagtcttgctctgtcgccaggctggagtgcagtggcgcgatctcggctcactgcaacctctgcctcccgggttcaagcgattcccctgcctcagcctcctgagtagcggacactacaggcgtgtgctaccatgcccagctaattttttgtattttagtagagatgggctttcaccatgttagccaggatgttctcgatctcctgaccttgtgatctgcccacctcagcctcccaaattgctgggattacaggcgtgagccaccacgcccggccaatgctcgctttatttcttat

SEQ ID NO: 80914 - DNA, 601 bp, Human
cccaatagttatcttttctgctcctctcccttctctcatcctccaccctcaagtagacaccagtgtctgttgtttccttctttgtgttcataagttcttatcatttaactcccacttataagtgaaaacatgcattatttggctttctgatcctgtgttagttttctcaggacgatagcttccagctccatcaatgttcccgcaaaagacatgatcttttcttttttatggctgcataatattctatggtgtatatgtaccacattttctttattcagtctgtcattgatgggcatttagrttgagtccatgtctttcctattgtgaatagtgctgcaatgaacatttgcatgtatgtgtctttatgatagaatgatttttattcctctgggtatatatccagtaatgggattgctgggccaaatggtattctgcttttagttctttcagaaatagccatactgctttccacagtggttgaactaatttacactcccaccaacagtatataagtgttcctttttctctacaaccttgccagcatctattattttttgactttttaataatgtatcttggctattttcattccattgtttta

SEQ ID NO: 80915 - DNA, 601 bp, Human
tcctcatctatatattcctattctaagttcatatggtacataccacacaatgatgtgtgattgaacagccttttattattttctaattattttatatatgtaaatattgtttctgcattaatattttaggctcacttacagaatagatcatgtcttctacttattctatagtgcttggcacagattaggcatttaatatttgttgagttggaatctcagtcagggtatttttacagtatagctgtatcaaatgagtcacagctgaccttcatcttatgtttctttagtggtttttttttttgcatccatatagatgcatttgtgggaaaggtacatctacctaagaattacaaaaaaaaaaaaaaaaaccctcagaatcagtcaagcacaagctgatgaagtacagaggccacagtgccatctagtgaatatcactagtttatgtctgctggtcccaagctcatttttcgaactttatatggtaaagagaaacaatatataaccagcacatgagacataactgtcttcactttaggtcacataaatattctatgaatagtctcatctttgtgtctgttgtaagtcttacagccattctgtg

SEQ ID NO: 80916 - DNA, 601 bp, Human
aaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataaaaatttwaaaaatgatacaagatatgaaagatcaacctaaataagaattagcggtggggcgtcgtgactcacatctgcaatctcagcactttgggaggctgaggagggcggatcacctgaggtcaggagttccgcctggccagcctggccaacatggtgaaacctcatctctacaaaaatacaaaaattagccgggcacgatggcgggtgcctgtaatcccagctactcgggaggctgagggaggagaattgcttgaacctgggaggcggaggttgcagtgagccgagatagcacaactgctctcca

SEQ ID NO: 80917 - DNA, 601 bp, Human
acattcatcaaaccacatatgatgtacaacacaaagactaaatcctaatgtaaactacggactttagttaaaaataacatatcaatattggcttattaactgtaacatatatagcacactaatgcgagatgttaatgacaggggaaacagtatgtgaagaaccgtgagggggtatatgaaaactctctatatttcctactcaatttttctgtaaacctaaaactgctgtaacaagtaaagtctattatttagaaacattgatcccgaagaaggcaagtgaggagagaaaaagaaacaggawagaaatgacaaatagaagccgggcacggtggctcatgcctgtaatcccaacactttgggaggctcaggcaggcagatcccctgagaacaggagtttgagaccagcctggccagcatggtgaaaccccatctctactaaaaatataaaaattagctggatgtggtggcacacatctgtgatcccagctacttgggaggctgaggcatgagaatcacttgaacatgggaggcggagtttgcagtgagcagagattgtactactgcactccagcctgggcataaagtgagactctgtctcaaa

SEQ ID NO: 80918 - DNA, 601 bp, Human
agcagcatatcacatataaaggagttccaataaagctagcagtgctcttcacagcagaaatataggccacgaaagagtgggaagatatattcaaagtgccgaagagaaaaaaccctgccaattaatactttacccagtaaagctatccttcagaaatgaaggagagataaagactttaccagacaaacaaaagctgagggagttcattgccacccagacttgtcttactagaaactaacagttagtttttttgaaaagataaacaaaatcaccaggtatggtggctcacacctgtaatccyagcactttgggaggctgaggtgggcagatcacttgaggtcagaattttgagaccagcctggccaatgtagtgaaactccatctctactaaaaatgcaaaaaattatctgggcatggtggcatgtgcctgtagtcccagctacttaggaggctgaagcagaagaactgcttgaacccgggaggtggaggttgcagtgagccaagatggcgccactgcattccagcctgggagacagagcaactgtctcaaaaaaaaaaaaaaaaaagatgaacaaaattgacaaacttttatttagactaa

SEQ ID NO: 80919 - DNA, 601 bp, Human
ctcagcaaactaatgcaggaacagaaaaccaaatactgcatgttctcacttataagtggaagctgaatgatgagaacacatggacacatgggggttagcaacacatactggggcttgctggagggtgggggctgggaggagggatatcataaggaagaacagttagtggatgctggacttaacacctaggtgatgggatgatttatgcagcaaaccaccatggcacacgtttacctatgtaacaaacttgcacatcctgcacatgtccccctgaacttacaagctggaaataaaaaaaaaataacattaaaaaaagatcttcctcaataaaaaaaaaagcttagggacttatgggacaacaacaaaagggcaaatatctgaattataggagttcaataaggagaaaagagatatgaaggtctggaaaacacatttcaatcaatagcaacagaaaactttccgaacctggggaaagataaatatacaggtacaggagggtcatcagtctccaataagatacaatccaaacaagacaacaccaagacatattataatcaaactgtcaaaaatcaacataaaagagaggatcctgaaagtaaca

SEQ ID NO: 80920 - DNA, 601 bp, Human
tccttgatcctcaccctcgcataagtttcaaagcctaacgtcatggtgtcatctataaagttgttagttcactgtaaaagaactgttgaaatatagaccatcatgtcacttcctccgaatcagaagactgtgtgttgtggaaatactgtatgcaacagggaaggctatgtttccaaagagaagtaaagccttcccctttgcatatggtaaagctcaagtaattgttgatacaaggacaaataaatgcatggaggaatgcagggggaaaaacagccattgaaaatcaacaagtaactcaacygtttctgtttaatattagatgagtttcagtgttaaaactcattgtaagacataatattaacaaatgggaaaatcaatgcttggcttctaaattagcctttgttttcatttgggtctaataaaaatgctaaaggaaaacctgaaaaaaaaaaaaaatgaaaacatgacatatcaaaatttgtgtatcgtcactaaacagtaattagatgataatttgtagcattaactgtccagatagaccagaataaaggtcttaaatcaatgacctcagtgttcacctttagaaataagaagaagtaga

SEQ ID NO: 80921 - DNA, 601 bp, Human
gtaatgtgagttgctaagctttcaaggaggatttgaacaccagaaaaatgcccaactgagcaactgcacatgcacttctgtgaatttatcttacggatatatttgcaaaagtaaacaaatacacataaggatgttcatccagcattgtttataagagtaaaatatgggccaggcgcggtggctcacgcctgtaatcccagcactttgggaggccgaggagggtggatcgcgaggtcaggagatcgagaccatcctggctaacacggtgaaaccccgtctctactaaaaatacaaaaaattrgccaggtgcagttgcgggcgtctgtagtcccagctactcgggaggctgaggcaggagaatggcgttaacccgggaggcggagcttgcagtgagccgagatcgggccactgcactctagcctgggtgacagagcgaaactctgtctcagaaaaaaaaaaaaaaaaagagtaaaatatgaaatcagcctaaattccatcataattaatgggcaaaacacactttggtacatccataatttgaaatataatacagaataaaataaaaaattgagtagctgtgtgttatattccattatattct

SEQ ID NO: 80922 - DNA, 601 bp, Human
gtagggtgggacaggtgaggtgagtgaagcacctagggtgaaaaatttaaggaggctctcagtgttgtacaagtaccaagcctttacttgtaccacccagagaataagttcctccttaagttttgtgccctaggtgtctccctccctccccctagttctccaccccagctcttactttcacacattctactttctgtctaccgcctcttacctttccaacttgatacctctattaccctgactccagcaatccttcaactgcagtaagacccccaacccactgatgttaccagtttttcastgtccctcatccccttgatgttctaccgcatacccagtttaaattccatggagactaattataaccactcccttgttccttgattttcctgcccttcttttgctttattgtattcatctggcaaaacctcaactctgattaagtccaactttctactgattttggtgcttacatccactcatcagctgaatgtggccagaaaaaaatacatacaactacttgttttattttaaaacttcatgaaatggccttagtgctactggcaagcatattgcacttccgtagtcattcactttctta

SEQ ID NO: 80923 - DNA, 601 bp, Human
cttatttctcactgtggcattttctcagtcataccattaagtatttatcaagtcccaacctcaccctcctctgcttcgctattttatgtaagtttccttgatctcaatagcactattttggcagtttattgactaagagcaagataagcagaggaaatactttctcttccacaggatgtaggttacttactttacagctgtaagaacttgttcctggtcttctgaatgttgagctaaatattccaaagctttttctgccacaatttgttgtccattctaaaaagaacaaatataatacgtyaaattacatctcaaagtgatactgcaaaatattatctatattcctgttcattaaagataagacaaatatctaaacatgttcattttgtattctcaaaaacgctactgcaagatggtagaatgaagatgcaactcactgacaaaaacagaacacatttgcattagccccggaaaccgaatcctccctattcacaaacactcaaagccttgccaatactacccttagtccactaggactaatcttattgtgctctttatcccccacttattagcagtaaacaaaagaaccccagattgtcag

SEQ ID NO: 80924 - DNA, 601 bp, Human
ttcttatttctcactgtggcattttctcagtcataccattaagtatttatcaagtcccaacctcaccctcctctgcttcgctattttatgtaagtttccttgatctcaatagcactattttggcagtttattgactaagagcaagataagcagaggaaatactttctcttccacaggatgtaggttacttactttacagctgtaagaacttgttcctggtcttctgaatgttgagctaaatattccaaagctttttctgccacaatttgttgtccattctaaaaagaacaaatataatacrttaaattacatctcaaagtgatactgcaaaatattatctatattcctgttcattaaagataagacaaatatctaaacatgttcattttgtattctcaaaaacgctactgcaagatggtagaatgaagatgcaactcactgacaaaaacagaacacatttgcattagccccggaaaccgaatcctccctattcacaaacactcaaagccttgccaatactacccttagtccactaggactaatcttattgtgctctttatcccccacttattagcagtaaacaaaagaaccccagattgtc

SEQ ID NO: 80925 - DNA, 601 bp, Human
gtgtgtctttaccctatctagcaaaattggggttaagagtaaatgcagttgtattgcttaatggtcaagatagtccactagttctgtatctatataaccctaccttatataaatgggagtggactgagggggaggcatttgctagattagtagtgttgcctgtaatctggaccagcacctaatgttctttcaaatgtggaaaagtttggttataaatagaaaaaaggaggaatagtagatgagagtaagaaatgaacaaatgagttatgtagtaagggaaatccaatattacatcagtacytcaaaagagtctcaaagcaaaagatgatattgtctcttagttcaattataccagatgcctgaaaaggtgaagccatatattgtggagaccactcctgcttttggaatctgaccaaacagaagcctggaaacctcagtagccttgccctgggacctgggagacaatttcatgatataatgatggactggacaaattattaatgactgaatgggactccagtaatgtgccagtatctttttttttttttttgagacggagtctcactctgttgcccagagtgcagtggcacaatctcggctc

SEQ ID NO: 80926 - DNA, 601 bp, Human
gactgactcattggcagtggccaatgacctggccatgtagtcttacagaagggaaatggaaaactggtccattaacaggatgtttgtatggtgtatgactctatggaaaatcactatggaaatctgagaggtgcattaatgtaggacatgttgatatccatcagaagaatccccttccaggtttggaaggtgatgagaatcaacaagtggatatctctgtgtgctcccttgaggcggccccctgggtccacgaaattagtgggcatctggggactcagcaaaaagaaatgagttgaacctrgacatattcctcttgtaacctctgaagttgaacctggacatattcctcttgtaccctctgaagcacaaaatgccaataactgttctgttttccaacaaaagagacagagacttaagatggctatgtggcagattcctcacggggaaggccttgaacacagctagcaagtcagactgatgctgatagccccagggtatgagtttcgacaggaatagacactaactctggattggcctttgcttacgcagtggtagatgcaaatgctcagagtgtaataaaagaactggaacagaatatact

SEQ ID NO: 80927 - DNA, 601 bp, Human
gaaaagcaaagagaacaaagactgaaaaaaatagaacagaatatccaaggactgtgagacaactacaaaaggtgtaacatatgtgtaatgggaataccagaaggagaagaataggtaatgcaacagaaaaaatacttcaaataatatgactgagaatttccccaaattaatgtcatatatatcaaatcacagattcaggaagctcagaacatcaaacaggacaaatgacaaaaaaagacatctaggcattttattttcaaactacaggaaataaaatatacagacaaaattctgaaaaaaagcctgaggaaaaaataccttacctaaagaggaacaaagataagaattacattctacttctgctcagaaaccacacaaaaaagaagagactgaagcaaattatttaaatgttgagagaaaatcccactaacccagaattttgtaccttgtgaaattatacttcaaaagtgaaggaaaataaagactctcagacacaggggtggagcaagattatggaacagaaggcccacccatcatcctcccccaccgtaggaacaccaaatttaaccactgtctacatacaaaaaatgactctcataag

SEQ ID NO: 80928 - DNA, 601 bp, Human
tttcagcccctgctatccccagatacttattctatgttcttgtagacttattcccataactcttcataatgtgttggtaattaacaactacttagagtattcccctcctaaagatatttacattttaatataggactttgggaggctgagatcccttcaaaggcaaagaaataagtcttaaatggtagaactttaggctccctgatgaatgtttctgatattttggtatagaaagatatgccccacattcttatgttataccctaaaaggaacaaattcttcttaggtcattcctgcttayatatatattaaaagttcctagatcaagagacaatcctagtctatatttagccctttactatagccatagtggttatagccttgttgtggtccatacatgagatacttattaaaagaaacttaccttataagaaagtataaaaaactctctcatcatcactggatctttgtcacattgcacagccaagttccaagctggaaattaacatgaaataacataataatatgaaattatgaaaatctaccatttagtctgtaccattacaatttctgatacttacacctttgatattaacatact

SEQ ID NO: 80929 - DNA, 601 bp, Human
cttacaccttatacaaaaatcaattcaagatggattaaagacttaaacattcgacctaaaaccataaaaaccctaaaggaaacctaggcattaccattcaggacataggcatgggcaaggacttcatgtctaaaacaccaaaagcagtggcaaccaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaayctacaaggaactccaacaaatttacaagaaaaaaacaaacaaccccatcaaaaagtgggcgaaggacatgaacaacaagtattctttagagagacagagtaccactgtccgattcatagggaccacacttagatgataaaaggcagaagtgcatcttcaattatgtatatagacatcctttcaaaagcaaagaagattatagaaaggttactagtttagagagttctgagaaaacacagaggtgtacatgagaaagaacacagaataaaaaagaacggtagttagaaacaaacaaaataa

SEQ ID NO: 80930 - DNA, 601 bp, Human
acatattaggttcagagacaaataaataggttgattgtgaaaggatggaaaaagttatgttatggaaacattgaccataagaatgttagggtgacactactaaaataagacaaaaatagactctaaaacaaaaaaaaaattactaggaacaaagaggaaaattttataatgttaaaagggccaatccattggaaatgtatagcaattataaacatatatgacctaacaacagagccccaaaaatataaagcaaaactgggtagaattgaagaaagaaatagatacttcaacttttattagytggagacttcaatagcccactttaagtaatgaatagaataagtaggcagaaaaccatcaaggatatagaacacttgaacaacactatcaacctactagacctaatagccataaaacatttcactaacccaagtagaatgtacattcttctcaagcacatatgcatggcactttctctaggatagctgacatgctaggccataacacaaacttcaaataaatttaaaataattgaagtcacaaagtatgtactctgaccacagtggaataaaatttaaaatcagcaagagaaaacaatttg

SEQ ID NO: 80931 - DNA, 601 bp, Human
aaaagagaaaaatatgactatctccataaagtctgaaaaagcatgtaattcaattgaatatccattgattttaacaaattctgaaacagggacagaaaaacacattgtaaaaacttcagtctaaacctaaaagccaataccatatttaatcaggaaatagaatcaagatattatataacttccaaaggcttactactgtttagattattttatttatttatttatttgtgtatttatgtatttatttatttattttgagacagagtttcgctcttgttgcccaggctggagtgcaatggcrtgatcttggctcactgcaacccctgcctcctgggttcaagagattcaaggatgcctcagcctcctgagtagctgggattacaggcatgtgccaccatgcctggctaactttgtatttttggtagagacgggctttctccgtgttggtcaggctggcctcaaactcctaatctcaggtgatctgcccgcctcggcctcccaaagtgctgggattacaggcgtgagccactgcatgcagcctatttagataattttataacaaaatattagcagtatctgttatcttgattgtgaagactag

SEQ ID NO: 80932 - DNA, 601 bp, Human
gcacacgaaaagatgatatgttttctgttctcaggatacacagtatattttcaggctacagagttttactcccattaaatcttctataataagtattttatttgggttttctctatctttactttttgttgtttttattcatttaagtgactgtcatagactacgagaagtaaattaaatttcatatgtttatgttcttccttataattcctataatttgatactcaaactgccaaagacataacacataagcaaaaacaaagtgacagaccaataatttctaaatgttggaaaacagaaytcatcaatatattaaaataataacatactatgaccaaatagggtttattccaggaatgaaatgatgacttaattttataaaatctattattataactcaatatattaatagttcaaaagagaaaaatatgactatctccataaagtctgaaaaagcatgtaattcaattgaatatccattgattttaacaaattctgaaacagggacagaaaaacacattgtaaaaacttcagtctaaacctaaaagccaataccatatttaatcaggaaatagaatcaagatattatataacttccaaa

SEQ ID NO: 80933 - DNA, 601 bp, Human
accatcctccagaccccagaatggtagatccactgacagcttgcactgtgcacccagaaaagccacagacactcaatgccagcccgtgaaagcaaccaagagggaggctgtaccctgcaaagccacaggggcagagctgcccaagacgatgggaacccacctcttgcatcagcatgacctgtatgtgagacatggagtcaaaggagatcattttggagctttaagatttgatgccctgctggatttcagatttgcttggggcctgtagcccctttgttttggccaatttctcccatttggwatgggtgtatttacccaatatctgtacccccattttatctaggaagtaactaacttggttttgctgttataggcttacaggtggaagggacttgccttgtctcagatgagactttgaacatggacttatgagttaatgctggaatgaattaagactttgggggactgttgggaaggcatgattggttttgaaatgtgaaaggcacatgagatttgggagggtccggggtggaaccatatggttaggctttgtgtctccacccaaatctcttcttgaattgtaatccccataattcccatg

SEQ ID NO: 80934 - DNA, 601 bp, Human
gctgcagatatttgcataagtaatgaggagcccaatgttaatcacaaagacaatagggaaaatgtctccagggcacgtcagagaccttcaaggcagctcctcccatcacaggtctggaggcctaggagggaaaaatggtttcctgggccaggcccagggcttctctgctttgtgtactcttggaactgtgacttctagccacatcctagccatggctaaaaggggccaacatacagctcaggccattgcttcaaagggtgcaagccccaagccttggtggctttcatgtggtgttgtgccygtgggtgcacagaagtcaagaattgaggtttgggaacttctacctagatttcagaggatgtatggaaacaaatgggtgtccgtggagaagtttgctgcaggggtggagtcctcatggagaacctctgctagggtagtgaggaagggaaatgtggggttggagcccccacacagagtccccactggggcactgcctggtggagctgtaagaagagggccaccatcctccagaccccagaatggtagatccactgacagcttgcactgtgcacccagaaaagccacagacactcaatgccag

SEQ ID NO: 80935 - DNA, 601 bp, Human
aaatattttcaagataaactaggaatggaagggaatagcctcaatctgataaagggcattaaaaaaaattccacagttaacattatactcaaaggtggaagcttagccctaagatcaggaacaagacaaggatgccctctctcactaccgctattcaacattgtacaggaagtttgctattcaacattgtacgggaagttttagccagataaattaggcaacaaagagaaacaaaaggcatccaaagtaaaaagaaagaagtgtaactctcactgttcacagatgacatgaccctacgtakagaaaatcccaaagaaaccacaagaaagctacaaattcggcaaagttgcaggtacaagatgaacatgcaaagatcaattgtgtttctatacatcagcaatgaacaatctaaagaggaaattaagaaaacaattcatttacaatagtattcaaaagaatgaatttagccaagaaggtggaagatctgtacaatgattactataacacactgatgaaagacattaaagaagacctaaataaatgaaaagacagcctacatttatggattggaagacttaatattgttaagatgtcaacattt

SEQ ID NO: 80936 - DNA, 601 bp, Human
ctttttctttatttttgattatttagtggcaaactaacaaagaacaaaggttcctcacttgtcaaagagctaaagttctttagaattgtgttacctcctatgttagaattgtgttacctcctatgtacatttatttatttatttatttatttatttatttatttatttatttttgtgatggaatctcactctgtctcccaggctggagtgcagtggcacaatcttggctcactgcaatctccacctcccaggttcaagcaattctcctacctcagcctcccgagtagctgggattacaggygtgcaccaccacaccgagctaatttttgtatttttagtagatacggggtttcaccatgttggccaggctggtcttgaactcctgacttcaggtgatccacccacctcggccttccaaagccctatgtttatttttaaatgtttgattgtcactttgtttaaataggtaaccaagtattgtttattgggcactcatgatcctatttatttatttttatttttaatttatataaatttaaaggacagaagttcagttttgttacatggatatattaagtagtagtgaagtctgggtatttac

SEQ ID NO: 80937 - DNA, 601 bp, Human
taaatccatttaaatgggaagtgcaaggagactgacatgaactgacttatgttaaaatactctggctgctgtgtggctattgaatttattaggagggcaagaagtgcagcagagaggacacttgggaagctattgcagtggtccaagtgagacatgagatagcttggaactaggtgatactagtggcctaatttgttattgagaatgggcacatcacaaatcacactactttcagcctactgtggtttgaatgtgtcccctccaaaattcagatgttgaaacttaatggccaatgtgatasgataagaggtggaacctttaatagcttattagacccagagggctcctccctcatgaacagggttacagatagcccttatggcccttaaaaaagaggcttccacacagcactaacttttcttgcccttccactttcctccctgtgaagacacagtgtttctcccctctggaggatgcagcaacaaggtatcatcttgcaatcagagagcagccctcaccagaaaactgaaccttctggatccttgaccgtagacttcccagcctccagaaatgtgagaaaaaaaaatttttctcttttgta

SEQ ID NO: 80938 - DNA, 601 bp, Human
gctagagtacatggagctatgaggcagagtggcaggagaggtggcgaggaaggtatctaaggaccggattatctatggccttgtagattatggtaaggacttgggattttattttaaatccatttaaatgggaagtgcaaggagactgacatgaactgacttatgttaaaatactctggctgctgtgtggctattgaatttattaggagggcaagaagtgcagcagagaggacacttgggaagctattgcagtggtccaagtgagacatgagatagcttggaactaggtgatactagtggyctaatttgttattgagaatgggcacatcacaaatcacactactttcagcctactgtggtttgaatgtgtcccctccaaaattcagatgttgaaacttaatggccaatgtgataggataagaggtggaacctttaatagcttattagacccagagggctcctccctcatgaacagggttacagatagcccttatggcccttaaaaaagaggcttccacacagcactaacttttcttgcccttccactttcctccctgtgaagacacagtgtttctcccctctggaggatgcagcaacaagg

SEQ ID NO: 80939 - DNA, 601 bp, Human
agtgttgagaaggaggtggagaaactggaagcctcatacattgctggtggaaatgtaaaatgatgcagctgctttgaaaaacactctggcagttcctcaaatgattaaacatagggttaccatatgacccagcaattccactcctaggtatacacacacaaaaaagtgaaaataggtccacacaaaaacttgtgcacaagagtttacagcagcattattcataatagctaaaagatagaaatgatccaaatgtccatcaactgatgaatggatgaataaaacatggtatgcccaggcaatrgaatattatttgaccataaaaagtaatgaagtactgacatgccacaacatgaatgaacttcaaaaatatgctaagtgaaataaggcagtcacaaaagtccatgtattatataattttatttaaatgaagtgttcagaatatgcaaagctatagaaacagaaagtagattagtggttgttcagggcttgtgggagaaatgcaagggaaactaaagggtacgttgctttccttttgaggtaataaaatgttccaaaattgattgtcagtggtggttgcacatatctgtgaatatactaaagt

SEQ ID NO: 80940 - DNA, 601 bp, Human
cttcttgtgaactttcaactgggctggtgctcactctaatggccgagttaaccagaagatacagtgctgtataaaccaacagtgactttattttaagcagaatagaggagagtttccaaactgtttcattagtcgacagaatttcttgggcatcagcatagaaagaatttcatgtcaggtgtcatacactaaactatgtgagacacttttcattcatccttcttggtagattgaacattgaaaaatgttttgaggtatgacatatatacaacaaactgaaagaagtgctctaaccttaaayagcttgatgagtttttacatgtgtttaaacccgtgtaataactacctagattgtgataacaaacacttccaacaatacagaaggttcctttgtgctcctttccagtcaataccatccaaccaaggtagcaactatctttgcttttctgcgtttatgttttgcatctattttcatgaggaatcttggtctgcagtttcttatattgtctttgtctactactggtatcaggataatagtctcataagatgaactgggaattgggccctcctttcaggatgagtttgtatagagttggtatta

SEQ ID NO: 80941 - DNA, 601 bp, Human
gctgttcacaagaatgcccccagatcatccccatatcatctttaaagttgagtcaattaagaacgattggttacttttgaggcattgactatagttcttttggctagcaaaaaggctggattgtatttactaacctgtattgtgatatatcaattggttcttcctttttgtagagcaataaagcctttttcaaggccttgagagcaatcaaaggatagtgtgcaggcttttccattgctattactagagtaagaaaaggaaaaaggttgtgaacatgataatgtcacccatcacagttttyatcccaggctaccacttgctttctctaatgaaactgggctgaaacagatgaacaaaaataaacaacaatgaattttataaatgataaatctacagtcgcttttggaaatagcttctactttctgggcagagtagcatggtgggattaccaggtaacatccttttttcagcaaacatcaacagaaaacctactgtttgtatgaccttgcacacagtcatacaggtgaagcaataatcttatgaatgacagtcaaggaagggcacactaagaaggaaacagaaagcagatcagtaaaagggc

SEQ ID NO: 80942 - DNA, 601 bp, Human
tggacacagaaaacaaaaaagtctccaatagataatattttatacagcacttatcggtgcttaaagtgcttagaaaaataatgaggcaaacatagcaagatgttaacatttgttaaatctgggtgctgcgtgcctgtaatcccagctactcatgaagctgaggtggagaatcatttgagcccaggagtttgaatccagcctgggcaacatcacgagaccccatctctaaaaataaaacaaataaatctgggtggtggatacgttggtgtttgttatattaacccctgtgcttttctgtacrtttggaatattatttagtgatgaaacaaagaaagaaaggtacttagcagttttattatatacacagattcacacaaagaagcaacttttccccttttttttctcctttgggaaaaccaagctccttgactttgctaaataattattggtctgtaatacaactctcagtatggagctgttcacaagaatgcccccagatcatccccatatcatctttaaagttgagtcaattaagaacgattggttacttttgaggcattgactatagttcttttggctagcaaaaaggctggattgtatt

SEQ ID NO: 80943 - DNA, 601 bp, Human
ttaaaaaactaaaagtataattgaattgcttgtaacacaaaggataaatgcttgaggtgatggataccccatttatcctgatatgattattatgcattatatgcctgtaccaaaaaatctcatgtaccccataagtatgggtacatgtacaccgctatgtacccacaaaaattaaaaataaaacatttttaaaactaaaaaacactggattgtagtgatagttgcacaactctataaatttactgaattgtgcacaagccatgggtgaattttatgatatgtgaattatacctcaagaaayctaattttaaaacaactgaataaacctgcacagaaaagaaaaagaaatcagcagaggagggactagaatacaggtcttcaatgttccttctactcttctgagaaaggatgcttctgagaaaggatgggaatagcaataacttttttcaaaaggttcatatcatcacagagaaagtaatcatcccaccatgatttgaaaatataaaataattcaaaatgcctggtggtactgctacttggacctaatccataatacacttgtgttagaaaatgtctactttcaactatttatatttcagaa

SEQ ID NO: 80944 - DNA, 601 bp, Human
gatttctcagcatgaccaaaacactacccacaaaagaaaaaattgatagattggacttcatcaaaattaaaaactttggctcttcaaatgatacccttaagaaaatgaaaaaacaagccagagactaggagaaaatacttacaaatcacatatctggtaaaggacttgtatccagaatatataaagaactcttataactcaataaaaaattccattttaaaaatgggaaaataattgaatagacatttatccaaacacaatacacgaacagtcaataagtacatgaaaaaatgatcatcaycattagccatcaaggaaatataaatcaaaaccacaatggctataacaaaaaaaagaaaagatgaacaatagcaagtgttgagaatgtagagaagctggaatcctcatacaccgctagtgaaaatgtaaaatggtatggccactttggcaaacagactgcagctcctccaaaagttaaacatagatttacctgatgacccaacaattccattcctaggtatatattcaagagaattaaacacatatgctcacaaaaacacttgcacatgaatatttatagtagcattattcatgatagcca

SEQ ID NO: 80945 - DNA, 601 bp, Human
aactgtaacccagaggtaagtatttgtgtatctaaacatagaaatggtagaggaaaaatgtggtatgaaagataaaaaatggtactcctgtatagggcactaaccatgaatagagcttgcaggactacaagttgctctgggtgagtcagtgagtgagtggtgagtgaacatgaaggtgtaggacattcttgtacattactgcagactttataaacactgtatacctaagctgcactcagtttattaaagggtatttttctttcttaataataaattaactttggccaggtgtggtggctcmcacctgtattctcagcactttgggagaccaaggtgggcagattacttgagcaaattacttgaacctgagtttgagaccagcctgggcaacatggtgaaaccctgtctctactaaaaatacaaacaaattagctgggtgtggtggtgcgcacgtgtggtcccagctactcaggaggctgaggtgggaggattgattgtacctgggaggtcaaagctgtagtgagctgagatcatgccactgcactccagcctgggtgacagagactttgtctcaaaaaatatataaatataaattgacctt

SEQ ID NO: 80946 - DNA, 601 bp, Human
cttcacaatggggacacaagctgagaaatgtatcattaggtgatttcgtcattgtgtgaatatcatagagtgtccttacacaaacttatatggtatagcctcctacacacctaggcgatatggtaaagcccattgctcctaggctacaaacccatacagcatgtgactctactgactactgtaggcaactgtaacccagaggtaagtatttgtgtatctaaacatagaaatggtagaggaaaaatgtggtatgaaagataaaaaatggtactcctgtatagggcactaaccatgaatagarcttgcaggactacaagttgctctgggtgagtcagtgagtgagtggtgagtgaacatgaaggtgtaggacattcttgtacattactgcagactttataaacactgtatacctaagctgcactcagtttattaaagggtatttttctttcttaataataaattaactttggccaggtgtggtggctcacacctgtattctcagcactttgggagaccaaggtgggcagattacttgagcaaattacttgaacctgagtttgagaccagcctgggcaacatggtgaaaccctgtctctactaa

SEQ ID NO: 80947 - DNA, 601 bp, Human
tcatagagacaagatctcgctatgttggccaggctggtcttgaacttctggcctcaagcgatactcctgcctttgcctcccaaagtgctgagattattattatatttattttacagatgaggatacagaggtatacataattaattaataagaccaaagtcatacagctaataaatggtgtagccagaatttatttgaactggttatgtggctccaaagtctgttctcttaaccactatgctataacgcccctcagtttaaaaataaggacgtaactttgctttttaaattgtcccaataycattttaccaattgttccctcagtgatgtgatataccttttccattgcatacaaaattctcatagatatgtggatctccttctgggctcagtcctgttctattaatctctttgtagatttttgcactaatgccatacttttaaaattaatatcattttatagttttaaaagtatttgataaggcaagtccttccttgttcttttacaaaaaatgttttggttcattttcttttagggaagaattttagaatcatcaagtttcattaaaaatcctattgagattttaattttgactgaatt

SEQ ID NO: 80948 - DNA, 601 bp, Human
tgggaggcagaggttgcagtgagccgagattgcaccactgcactccagcctggtgacagagcgagactccatctcaaaaaaaaaaaaaaaaaaaaaaaaaagtaaacgatcaccttggttgctgggcaaagaaaggaaggaagaaagcaagagtagatgtgaggccagttaaaaggttcctgagatcactaaactagctaagataaaaggtgtgtaacttgaactaggttactgatggtgaaagataggaggaagtagatgaatttgagagatatttgggaggtcaaattgattgatagtrcttggtgatagattagaagtgggagtgagggaggtgctgaggatgactcctagatgtctggcttgggcaaccagaagaatgatggtgtcatccaatgagttagggaacactcgagttttattttaatttgcattagttgccctcatgcccagcattgcttatgaaaatcattaatcctcaataaagaaatgcatccacacagctactgacctgaaagccacatggacttgcctacgtgtaatacaaatcaatgtcagcaaactgaggtgtttgctctgatggtttttggggccacatatt

SEQ ID NO: 80949 - DNA, 601 bp, Human
aaccattgagaggaacaatgagcaagatcctttcctagccaaggaggatggggttgagtccttgtggagagcccagccataacctcttgccccctaggtcatgtcatctgccctagccctctccctccttacctgagtttcatagctttccttgaaggaggtaaggtggttaaggaaacgcaaggccaggccacaccacttttcagcagatgcatacttgctcctgctaaacataagtactccggtattccaggacttgaccatcagccagagaatctccatttctgggtagtctttctawaatccaagaacagaaattttgcagttattactgtcacagttcattgtggcactacctgtatccatgctatgtccctttattactaaacaaacaataggagctctgctgatgtttaggaaggtctgtgctcctggagagtgcaggaggagagcactttgaaggtttgtcagctgtagaatgttccatagcaagatctcatgaagagacgtaaaccgaggtcctctctgactgaaggaaagaattagaaagattcctaatcttcctgaggcacgagaaaaacttgcatactgtttggggctt

SEQ ID NO: 80950 - DNA, 601 bp, Human
gaaccattgagaggaacaatgagcaagatcctttcctagccaaggaggatggggttgagtccttgtggagagcccagccataacctcttgccccctaggtcatgtcatctgccctagccctctccctccttacctgagtttcatagctttccttgaaggaggtaaggtggttaaggaaacgcaaggccaggccacaccacttttcagcagatgcatacttgctcctgctaaacataagtactccggtattccaggacttgaccatcagccagagaatctccatttctgggtagtctttctrtaatccaagaacagaaattttgcagttattactgtcacagttcattgtggcactacctgtatccatgctatgtccctttattactaaacaaacaataggagctctgctgatgtttaggaaggtctgtgctcctggagagtgcaggaggagagcactttgaaggtttgtcagctgtagaatgttccatagcaagatctcatgaagagacgtaaaccgaggtcctctctgactgaaggaaagaattagaaagattcctaatcttcctgaggcacgagaaaaacttgcatactgtttggggct

SEQ ID NO: 80951 - DNA, 601 bp, Human
ttatttggtaacaaggctttttctctaccaaacctctcctggttagccaatggcccagaactctgcaactgagaatagttcctggagaaaatgcctttttcaacagttattgctttgagcagaggccagtcctttcccacatgcactggcactgacagtgatgcatctttccagagctcactcttggcattcctcttaattagattccatttgctatccttaaatttccccctgttctctgtccttcttggtttttgctctaaggaattactgtttatggtctcctgattcttgaagttaygtggaaccattgagaggaacaatgagcaagatcctttcctagccaaggaggatggggttgagtccttgtggagagcccagccataacctcttgccccctaggtcatgtcatctgccctagccctctccctccttacctgagtttcatagctttccttgaaggaggtaaggtggttaaggaaacgcaaggccaggccacaccacttttcagcagatgcatacttgctcctgctaaacataagtactccggtattccaggacttgaccatcagccagagaatctccatttctgggtagtctt

SEQ ID NO: 80952 - DNA, 601 bp, Human; identical to SEQ ID NO: 38510

SEQ ID NO: 80953 - DNA, 601 bp, Human
ccgccgaggacgccgcgcctgtggccgcaagagcgctccgagcgctatgcgccggcgaggcgcgagggctcgctctctcactcccacccgcgctggtccctcctccgcctccgccccctgcagctgcctgctgggccttgtagttccccagccgcggccccaaaggacggggagcgggccgagctgtccggcgctctgcccttctcttcctacagcctggtctcctttggcgtttgcgcccctgcatctgagcacgtcccagagggcgccggaatgtcaggccctagacatagcagcggtytgggggctagggggcaggtgaagagacgccgcagccttgaggttgtacctggtagcgtgggctttggagtctgtgcgccttggggaaatgattttcgcgctctaaatctctgttttcccatctgtaaatgggggataatagtgcttttcacatagagttgaggcgtcaacgagggcctagcgcatagttaacacttagtaaatacaagccggttttattataaggtcagcccctcctcaaacccttcccttggatttcagctttccccagccacataatttaggttttgtggtccaccgg

SEQ ID NO: 80954 - DNA, 601 bp, Human; identical to SEQ ID NO: 80953

SEQ ID NO: 80955 - DNA, 601 bp, Human
tttttgagcgttcagctcaatggcattaaacacatgcacattgttgtacagccatcaccactgtccatcttcagaactttttcatcacccctaaactgaaacaccatacctattaaacacgaactccctactagccactctgacaactgcaggttcttttttgagttctgcatatccagcctttaatgatgacttggttctcttaccactttgctctatcggaaataccttgaaattttccttcatagtttgctgtgacatttggtgttcacttgtcagaagctcatttatatttatggctttttttttttttttttttgagacggagtttcgctcttgtcgcccaggctggagtgtggtggcgcaacctcagctcactgcaacctccgccccctgggttcaagggagtctcctgcctcagcctcccgagtaactgggattacaggcacccgccaccatgcccagctaattttttgtatttttactagagatggggtttcgccatgttgggcagtctggtctcgaactcttgacctcaggtgatctgcccacctcggcatcccaaacttctgggattacgtgagccaccgtgcccggccgc

SEQ ID NO: 80956 - DNA, 601 bp, Human
ccacctcggcatcccaaacttctgggattacgtgagccaccgtgcccggccgcacatcatttatatatgaagattgtctctgttcttttttctttttctttttcttttttgttttgttttttgagagagggtctcactctgttgcccatgctgaagtgcagtggcatgattatgactcactgcaaccttcacccacctcccatgctcaagcaatcgtcctgcctcagcgaccctccaccagccaagtagttgggactgaaggcatggcacctgccactatgcccagataattttgtgtgtstgtgtgtgtgtgtattttttggtagacatggggttttaccatgttggcccgactggtcttgaactcctgggctgcctcaggattacaggagtgagtcgctgtgcccaatctgttcttttttccttgacttctatatttaatgtaatttgtaggggcatcagtctatgatggcaaatgcaaaagaagctgtggtagtttcatgatacagaatatacttatattaacattttaaattagcattaaaacaaaatttgagacaaattttacagactttattaagtcttggattctcagtgtgaa

SEQ ID NO: 80957 - DNA, 601 bp, Human
agacaaattttacagactttattaagtcttggattctcagtgtgaagaatatagagttagattattctgtgtagagatggtataaggtcataagagcattggttaatgtagtagaattagaaatacaaaaggaagaatagttatgtgagggagcagaacggatggcagtaagtccagatgtcaggcaagtgaaggagtcaaggataacttccaaggtatagagcctgacataccaagggaaatattttattattaacaaatgtagggtaatttagaggaaaagcagattccaagagaaacsatttggtgagctatcaagctagatctaccttgcaggaagaagagatacatggttagaggtatattttaagagttactggcatagaggagctaaggctaatcatttagtgttcctgcagaatgaaagaatacatatttaggatagcagaagtaagagtgttagggttttcctctaatgttggagacaagaagctgaccctagatagcaaatgagaattgggataattatgcccaagaatccaaggaagagatgttttaagctggccggaaaagtcaacagtatagaatgtagcagagtgtt

SEQ ID NO: 80958 - DNA, 601 bp, Human
ctcgaactcctgacctcaagtgatccacctgccttggcctcccaaagtgctgggattgcaggcgtgagccactgcgccaggccaactaaaatttcattctttttctcaaggaaaatatatttatatgttctcaatgaagaatgtctggccatagtgatgtttaaagagatttgctatttctttttccgataaatctctttcttactataaaacgttctgtggtgtttacttttagaaattaaagttagctaattgattttattttttaatttctttctttttttatttttttgagagggartctcgctctgtcgcccaggttggagtgcagtggcacaatctctgctcactgcaagctccgcctcccaggttcacaccattctcctgcctcagcctcccgagtagctgggactacaggcgcctgccaccacgcctggcaaattttttgtatatttagtagacatggggtttcactgtgttagccaggatggtcttgatctcctgaccgcgtgatccacccgccttggcttcccaaagtgctgggattacaggcgtgagccacggcgcctggcctattttttaatttcaagacatcttttaa

SEQ ID NO: 80959 - DNA, 601 bp, Human
cgcctggcctattttttaatttcaagacatcttttaaaataatttgagagatatatcagacatttaggctggaatttcatgggtcagaacacacattgtaattttgcaaagtagtcctgttataatttatttgaaaggtgtttctaatatgtggaaatttggaagtataatttggttacatatgttttttgttgaaattaaagattgtgggctgggcatggtggatcacgcctgtaatccagcacgctgggagactgaggcgggaggattgcttgaagtcaggagtttaagaccagcctargtaataaagccagaccttgtctctatgagaaggaaaaaaaaattagctaggcacagtggcatacctgtggtcccagctactcaggaggatcctttgagcctgggagttcaaggctgcagtgcactatgattacaccactgcactccaggctgggtgacagcgtaagaccctcatctcttaaaaaggaagaaagaaaaaaaaagtggtggtgttagtaaccacactggttttgagaaaattctttttaattttttaattttttttattttaatgggggaaggtgacttaattggaagagag

SEQ ID NO: 80960 - DNA, 601 bp, Human
tggttgtggtaaacttgtttactcacatatcttttgaacatcacggtgttcaaaaagctgcctgggccaggccccgtgatcatgcctataatcccagcttttgggaggccaaggcatgcagatcacctgaggtcaggagtttgagacaagcctggccaacatggtgcaactctgtctctactgaaaatacaaaaattagccggatgtgttggtgggcacctgtaatctaagctacttgggaagctgagccaggagaatcatttgaacccgggaggtggaagttgcagtgagctgagattgygccattgcactccaccctgggggacagagcaagactccatttaaaacaaaaaaaaaaagggctgcctgagataaatattaaagaacagacacagtttcttttctttctttcttttttttttttaccttctccttcctgatggaaaagaacagacacagtttttatcattaagtaccttaatagtcaagtaaatagtaataagcgaataatgattataagaacaacagcaccattaatttatacatcttaggagttgttcagcactgacatgaaagctgccaagataaatattttagcagc

SEQ ID NO: 80961 - DNA, 601 bp, Human
ttccatagctattagttgggcagacacagtttctgtggtgtgttaatgaatgtagctgaagctaggtaatcaaatgatcttgatttccttcaaaataatcatgtgaagaatgtagactttattgcagctatgcttttatttctccaaacattttttagaactttcttttggaatttccttcagtgcctatgatgattcttttaaattctccattttgattctgtaagagtcggtttacaaactaagtaatggaatttggagtcgaaaattaagtgttactgcaaagtaatgagagtagggtttttttttttttttttgagacagagtcttcctctgtcgcccaggctggagtgcagtggtacaatctcagcttactgcagcctctgcctcctgggttcaagcaattctcctgcctcagcctcccgcgtagctgggactacaggcacgcagtgccatgcccagctaatttttgtatttttagtagtgacggggtttccctacattggctaggatgatcttgatctcctgacctcgtgatacgcctgcctcggtctcccaaagtgctgggattacaggtgtgagcccctgcgcctggccgaga

SEQ ID NO: 80962 - DNA, 601 bp, Human
agaccacttgtattatagattgttcttcaatctcttttttttctgatagtttcctcttgatgacattcctgtgcaattttggcaggaaaactatgaaagtgatgttttgttcttaccagtacatctaattaggaagcaaattatgtcaatttgtaccattctgtctttttttcctaactacttattgaacaaatctttaaccagtcttcctattttgagccccaggttcacctcccataaaggtacttggtgctgctgactcataatacccgtctcgtattctgctatgtaaatgaacttrcttctgggttttcctcatttgctggcttaggtttcagttttcctggctctaccaggtcactttcatttgtccatgtgctatctagtgcatccatctgatttccagcttcccaaatctgattgctcttatcttccctgttccctttatccttgtagaatcttgcccttctaaaagtaacgtcattagcaaaactagatgactacgtaaagtcaggatagtgcttacttacctcttgggggtagggaatagcctgggaaaggatatgagggaaccttataggttctgtaaaattcctgtagt

SEQ ID NO: 80963 - DNA, 601 bp, Human
ctgctgctgtggccacactctgcctcctaacagacagtgttggcactgacccagacctcaacagtattttaagccaatattctcatcctcatgtcatgaaagcatgattgaaaattttgtgaccatttgataatggcctgagattatactgttagctcacatgctgaatgaattagagtcagttgagctgtgccagacagaaaacttaaaaataaaggtactagaagtgtatttctctattacttaagtaaacttgtaagttttcaagggctaatatggtggttttatgataatcaggttstaccatcagccaacatggcttcaagtcatggcacaatgatcacattagcatttcaggtatcaggaagaagttgggcaaagaaagcctcgcctgttcttttaaaggacactttctggaagttgtacattcatcattttcacttatattctattggccaacaagttcatgcaaaggatgctgggaatttagtctttgttatgcttggccatatggccagtgaaaaactggggcaagaaaaaagtataaatagaggggactactagcagtttctgtcctatatgctttagcggatgcaggggg

SEQ ID NO: 80964 - DNA, 601 bp, Human
tttagctatctgaaaattaaaaagtaatctaaatagtaaaaccctcaatttacagaatattgttgtaataaagttatattaatataatatttgaactaaacatgacctcaaatcatgttaatagaatgttagaacaaagtgatgacttatagtttgtctaggtcaaccctattattttataagtaaatggatccagagagtttgaatgattactcatgttggtgcagctattgttgtccaaggtggttgggacatagagctctgttggccagatttactttctggtgttcttagtactacrtttgtgaagagttgtaaggccatcagaattaacgtttatcagccttccataatccaagcaatatagtcaattagattggtaggagtttgtggggaaagtggcaggttaagtatgtttccataacttctgtcccaatgaaatgaacaaaattattcaaaaaataagcaatttttttaaatggaagagaatacaattccattatcacaggctccaaagaaaatctgtttgatattaatgacatttgagtctaaacactgaaatccaatacagggtgcttcatgagagatttgtaagttttac

SEQ ID NO: 80965 - DNA, 601 bp, Human
gctgagacaggaggattgcttgagcccacaaattcaaggtcacaaagaactgtgattgaacgactgcattccagcctgggcaatagagcaaaaccctgtctcaaaaaaaaaaaaaaaaaaaaaaaaggaccaacttaatggcacccttttcctaaagatctctacccataatccttcagttgtagaggagaatgagaactgtgggcttaagtggaccatagtagaaaggaatgtggtactgagacacatgtaggggctttgaggtcagattgtttataaggtctcttcccttatttaccarctggggagaattgacctagttagcagtaccacaagcaggggagagatggaaagatggaaaaacaatattttgaagtcagcttttgagttgttaaacaggattctataacccaacaaaaaatttgtttttgcctatcctaatgggtgaaaagctgaaatctaacatgtatctacacatacttgaccaagagaccagatgtgctcctgagatttttgctttccttttcctttctttgcttttttttctggtaacagttctattgagatataattcacataccatataacttaccagtttaaa

SEQ ID NO: 80966 - DNA, 601 bp, Human
gtactgagacacatgtaggggctttgaggtcagattgtttataaggtctcttcccttatttaccaactggggagaattgacctagttagcagtaccacaagcaggggagagatggaaagatggaaaaacaatattttgaagtcagcttttgagttgttaaacaggattctataacccaacaaaaaatttgtttttgcctatcctaatgggtgaaaagctgaaatctaacatgtatctacacatacttgaccaagagaccagatgtgctcctgagatttttgctttccttttcctttctttscttttttttctggtaacagttctattgagatataattcacataccatataacttaccagtttaaagtgtacagttcaatactttttttaaagatgtaatttatttggaatccaagctttgtttcacaagtttattatttatttttattattattattgttattctttttgagactgagtctcgctctgttgcgcaggctgtagtgcagtggcacgatcttggctcgctgcaacctctgcctcctgtgctcaagcgattctcctgcctcagcctcccgagtagctgggattacaggcgcct

SEQ ID NO: 80967 - DNA, 601 bp, Human
tgtttataaggtctcttcccttatttaccaactggggagaattgacctagttagcagtaccacaagcaggggagagatggaaagatggaaaaacaatattttgaagtcagcttttgagttgttaaacaggattctataacccaacaaaaaatttgtttttgcctatcctaatgggtgaaaagctgaaatctaacatgtatctacacatacttgaccaagagaccagatgtgctcctgagatttttgctttccttttcctttctttgcttttttttctggtaacagttctattgagatatamttcacataccatataacttaccagtttaaagtgtacagttcaatactttttttaaagatgtaatttatttggaatccaagctttgtttcacaagtttattatttatttttattattattattgttattctttttgagactgagtctcgctctgttgcgcaggctgtagtgcagtggcacgatcttggctcgctgcaacctctgcctcctgtgctcaagcgattctcctgcctcagcctcccgagtagctgggattacaggcgcctgccacgacgcctagctaattttttgtatttttagt

SEQ ID NO: 80968 - DNA, 601 bp, Human
gcagtgagccgagatcgcgccaccacactccagcctgggcgacagagcgagactgtctcaaaacaaaaacaaaaacaaaacaaacgagattgagaccatcctggccgacatggtgaaaccccatctctactaaaaatacaaaaattagccgggcgtggtggtgggcacctgttgtcccagctccccagctttggggagaatgaggcagaagaatcgcttgaatccaggaggcggaggttgcggtgagccgagatcgcgccactgcactccagcctggtgacagagcaagactccgtctccaaaaaaaaaaaaaaaaggcatcttaccttattgttttaatttacaattattattagtgagattgaactttttttgtttttgttttgtttctgtcatgattactctttccttttatttggtggcatttcattttgcatatttcaaaagtatttttgtctttttgaagtttactgtgctttgatacagaaatttttatctttattttagaataaggagagattatcttctgctgttactgacctcaacataataatggagcccacagaatgctcagaattaagtgaatttgtgtctaggtaag

SEQ ID NO: 80969 - DNA, 601 bp, Human
ggctgaatagaagggaaggatcctgcaaaggaattagaaaaggaactgtttgagaggtagggagaataccaagaatgtgttgtgtcatggcagagatcacatatttccttttgttcagaccatagtttggaagtagcatctgctatttggaaattacaaaaggaagagtagtgagatatctctcttcctgtaataatgagcatattatagttacttaataaatatttaatcccagctttttgggcaattttttagactgggttcccattttgtggagagtgactggtattttagaaagggkgctgaacataggtcagaagacctggattttattccagattcaactacgtgtaagttacctctccttttggagtttctttcttctttatctctgctgttatgcaatttaaatgttatatgcctaattatgaatttatttttagtttttcattatagatctgtagtttttcagacaggattggtatctttaggttttgaaaaatttttagtcattattttattgactcttgcttctaccttgatcttcccttatcacagtctactttcactttaaatagtaagcatttcacatgtactataa

SEQ ID NO: 80970 - DNA, 601 bp, Human
agtcattattttattgactcttgcttctaccttgatcttcccttatcacagtctactttcactttaaatagtaagcatttcacatgtactataagaacaacagtatactttccatttattttccctcaaccattgtattattattttcatataattgtcatacacttttacatgttccaaatgtctcagggcattgttactatgtttgccttagactgtcaattattttttaaagcaattaaaaataagacaaaacttgttttgttttgttttgttttgagatggagtcttactcggtcayccaggctagagtggaatggcatgatcttggctcactgcaacctctgcctcccaagttcaggcaattctcctgcctcagcctcctgagtagctgggattgcaggcatccagccaccatgcccagctaattttctttctttctttctttcttttttttttttttttgtgcatttttggtagagacagggttttactacattggccaggctggtcttgaactcccgacctcaaatgatccacccaccacggcctcccaaagtgccaggattacaggcatgagccaccgtgcctggctgacaaa

SEQ ID NO: 80971 - DNA, 601 bp, Human
agtcttactcggtcacccaggctagagtggaatggcatgatcttggctcactgcaacctctgcctcccaagttcaggcaattctcctgcctcagcctcctgagtagctgggattgcaggcatccagccaccatgcccagctaattttctttctttctttctttcttttttttttttttttgtgcatttttggtagagacagggttttactacattggccaggctggtcttgaactcccgacctcaaatgatccacccaccacggcctcccaaagtgccaggattacaggcatgagccaccrtgcctggctgacaaaacgtgtttttgtatatttatcttcattttttcatttccaacattcttcatttctttatttcattcttcatttcatttgattcagatttctaactgctatgctccttcttccttaagaacttcctataacttttttttttttttttgagatggaatttcgctctttttgcccaggctggagtgcgatggcacaatctcagctcactgcaacctctgcctcccgggttcaagtaaatttcctgcctcagcctcccaagtagctgggactacaggtgtgtaccaccac

SEQ ID NO: 80972 - DNA, 601 bp, Human
aggctagagtggaatggcatgatcttggctcactgcaacctctgcctcccaagttcaggcaattctcctgcctcagcctcctgagtagctgggattgcaggcatccagccaccatgcccagctaattttctttctttctttctttcttttttttttttttttgtgcatttttggtagagacagggttttactacattggccaggctggtcttgaactcccgacctcaaatgatccacccaccacggcctcccaaagtgccaggattacaggcatgagccaccgtgcctggctgacaaaacrtgtttttgtatatttatcttcattttttcatttccaacattcttcatttctttatttcattcttcatttcatttgattcagatttctaactgctatgctccttcttccttaagaacttcctataacttttttttttttttttgagatggaatttcgctctttttgcccaggctggagtgcgatggcacaatctcagctcactgcaacctctgcctcccgggttcaagtaaatttcctgcctcagcctcccaagtagctgggactacaggtgtgtaccaccacacccggctaattttgtat

SEQ ID NO: 80973 - DNA, 601 bp, Human
tgccaaaccgttttccagaatgaccatactgttttgtattcccaccagtaatgtgtgagaatgtctgttaatatttttgtgaattaatttctgatggtcacctaattttagatgtaatagtcccaggaatttattgttagaataaaattttggaatctttatcctaaatttctctttgtgttcgctttatacttgagaaggagacatttggagttatttttgtttcctgactactttagctgaaattgaaatgggttactgccaacattttatgaaagaaatccatgacatctgttttacrtttagtgaagtttggactttgcttaggaaaaatagataaattacagtcattcttacagctgtgagagccaacacccacacccacacacaaaatttctttctatatggaaaactcttatgtgctgtagtacagtatcctttatgaagatgcaaatggaagaataaaggaattgtgaattttttaaagttcattgtaaaagaacagtcttttcttctgtgtgtatgtgtttaaacttgagtcatcatagcttttaagattattttcatggcttactccctcatcacatgattaagagtttat

SEQ ID NO: 80974 - DNA, 601 bp, Human
cataactctttcctcttttaaaacagaaactttggccaggtgtggtggctcacgcctataatcccagcactttgggaggctgaggcgggtggatcatgaggtcaggagttcaaatccagcatggtgaaaccctgtctctactaaaaatacaaaaactagctgggcatggtggcacgtgactgtagtcccagctacttgggaggctgaggcaggagaatcgcttgaacctgggaggcggaggttgtggtgagccgagagcaccactacactccagcctgggtgacagagtgagactatctcaaaaaaaaaaaaaaaaaaccagaaactttgtacccataaacaataactcccacttcctccctctcctcatccaccattctactttttgtctgtgtgattttgattaatactatctaagtattaatctaagtacctcatataagtagaatcatacagtatttgccttttttctttagatggagtctcgctctgtcgcccaggcaggcgtgcagtggtgtgatctctgctcactgtaacctctacctcaccagggattctcctgcctcagcctcccaagtagctgggattacaggcacccgct

SEQ ID NO: 80975 - DNA, 601 bp, Human
tcctcttttaaaacagaaactttggccaggtgtggtggctcacgcctataatcccagcactttgggaggctgaggcgggtggatcatgaggtcaggagttcaaatccagcatggtgaaaccctgtctctactaaaaatacaaaaactagctgggcatggtggcacgtgactgtagtcccagctacttgggaggctgaggcaggagaatcgcttgaacctgggaggcggaggttgtggtgagccgagagcaccactacactccagcctgggtgacagagtgagactatctcaaaaaaaaaaraaaaaaaccagaaactttgtacccataaacaataactcccacttcctccctctcctcatccaccattctactttttgtctgtgtgattttgattaatactatctaagtattaatctaagtacctcatataagtagaatcatacagtatttgccttttttctttagatggagtctcgctctgtcgcccaggcaggcgtgcagtggtgtgatctctgctcactgtaacctctacctcaccagggattctcctgcctcagcctcccaagtagctgggattacaggcacccgctaccatgccca

SEQ ID NO: 80976 - DNA, 601 bp, Human
tgattcctggacccatgaatcttggctatggaagaaacagtaccatatattggatgctgattcagagcatacatggccttctggagagatttgccccagctttgcaaagtattgtcacctagttagcattgtaattgtgacttcaaaaggccattctactgttctgtcaatccagctgcttcaggatgattgggaacatggtaagaccagtgaattccatgagcatgagcccactgctgcacttctttagccgtaaagtgagtgccttcatcagaggcaatgctgtatggcatactgtgayggtggataaggcattctgtgagtccacgatggtagtcttggcagaagcattgcatgcagtataggcaaacccatatccggagtaagtgtctattccagtgaggacaaacctctgccctttccattatggaataggcccaatataatcaacctgccaccaggtagctagctgatcaccccaagaaatggtgccatatcgggggtcagtgttgatccctgctgctggcaaattggccttgtcagacgtggtgagtggaagtccttgttgctgagccatgcgtaacctccatccctgccacca

SEQ ID NO: 80977 - DNA, 601 bp, Human
tctccagatctttctttagcatttttaagatggtggttgtaaagtctgtatggtagatctaccatcagattttttttcagggatgctgtctattcatttattttttttcatttcacgaggccattcttttgtatctctttttttttctttctttcttttttttttttttgagatggagtttcgctcttgttgcccaggctggagtgtaatggcatgatctgggtgcactgcaacctctgcctcccaggttcaagcgattctcctgcctcagcctcccaagtagctaggattaaaggcatgygccaccacacccagctaattttgtatttttagtagagagggggttttgccatgttggtcaggctggtcttgaactcccggcctcaggtgatccgcctgccttggcctttcaaagtgttgggattacaggcatgagccaccgtgcccagccttcttttatatttctttgtatcccttgtgttttgttgttattgttgttgaaaagggctcatttgaacctaataatgtggtaacccccaaagtcagattctccctcttccccagggtttacaggcttgttattgttattatttattttatt

SEQ ID NO: 80978 - DNA, 601 bp, Human
tgacagtaagactccgtctcaaaaaaaaaaaaaaaaaaaaagaattatttccagggttctgtcccattctaaaaacttatatatttatgaattgaagaataaaatatatctgagaaatgatggaatttactggaattggaatgatagagctgtagaagaacatccacaacttagatctcttctttataacatgagatgattaccaatacttggggaatccttctcagtgaaaccagatatacaaaacactgtttctttgggccaccctctagacataaaattacttcattttacagattgyttattgtttggtattacttgtggcacagattcctaaactcctttagtaagtatatgtgcccaccactatttacagatcactcaactgatctagttaaagtcctcagtaatgaattttatgtgccagatgctttcttcagtatttgtggtctttttctttttaaaaaggcattatttttaaaataaaacacagaaaagtataaaaagttatacctggaagggatttgggaagaaattattcctctgattaatcattgtacaggtaagctgaatgattattacacacacatgctcatttttt

SEQ ID NO: 80979 - DNA, 601 bp, Human
ttgaggatattgtttgagaggatcacgattcagttagttcagtactgacttccccaagagctctcatggagttactgcaggttgaacatccataatctgaaatccaaactgctctaaaatctgaaattttttgattgccgacatgattccttaagtggaaaattccacacctgacttgcgtttgcagtcaaaacgcaggtgtacaacacagttcattcaacatcctcaagggaaaaagaccctccctgctcccttcagctgcggtagcagcacacattcataacagaacaagaaatcataycagattctaaaatcaaagctagattaataagacaaaagttgttgttaatgaggcagataactgtggaggaaacgtttattttatttttatgtattcatttattttttgagacagagtctcactctgtctcccaggctggagtgcagtggcacaatctcggctcactacaacctccacctctcgggttcaagcaattctcctgcctcagcctcccgagtagctggaattacaggggcacgccaccacacccagctaatttttgtatttttagtagagacagggttttgccatgttgggcag

SEQ ID NO: 80980 - DNA, 601 bp, Human
ttaatcaaaacacagcatcataggtggagactgaaagcctaccattgttagttgttgctttttttaaaaagctggtaactggtattttggtgatactacactgcatacattattttttcactatttaatggcatgtcatgttttttactgttaagttcttatgtgtgaataagttaagaaaattattgcttattggtatcataaattcagaatcaggaatgatgatgatgctatatagccatagatcatctacatgggtggctgagatagtgacatctttgttttctcatggatcattgtrcacaaactttgtttcacacacaaaattatttaaaatattgtataaaattaccttcaagacctggacactgtccccaagatatctcattatatacatgcaaatattccaaaatctgaaaaaaattcaaaatctgaaacgcttctggtaccaatcatttttggataagggatactcagcctgtattctagcttccaataattttatcaaagttagcttcaaagcagcttcatggggccgtttattcaatgatcaagagctacaccaaattaatcaccttcataaaaatataactatagctgc

SEQ ID NO: 80981 - DNA, 601 bp, Human
ggctgagatagtgacatctttgttttctcatggatcattgtgcacaaactttgtttcacacacaaaattatttaaaatattgtataaaattaccttcaagacctggacactgtccccaagatatctcattatatacatgcaaatattccaaaatctgaaaaaaattcaaaatctgaaacgcttctggtaccaatcatttttggataagggatactcagcctgtattctagcttccaataattttatcaaagttagcttcaaagcagcttcatggggccgtttattcaatgatcaagagctrcaccaaattaatcaccttcataaaaatataactatagctgctgtgaagaacaatttcatgaggtctctctgggaagcagtcccaatgagttcatcgtctgttacagaaccttttgagtgaccaaatatggagaaactaaatctcacctctggtatttatatattgtggatagtttttttggctactgacgggaatcagcagcttatatttgacatatatctgtgttcatatgcactgcatgattaatatttaaaagttaagaataaatggctcagatgcagtggttcatgcctgtaatcc

SEQ ID NO: 80982 - DNA, 601 bp, Human
catggatcattgtgcacaaactttgtttcacacacaaaattatttaaaatattgtataaaattaccttcaagacctggacactgtccccaagatatctcattatatacatgcaaatattccaaaatctgaaaaaaattcaaaatctgaaacgcttctggtaccaatcatttttggataagggatactcagcctgtattctagcttccaataattttatcaaagttagcttcaaagcagcttcatggggccgtttattcaatgatcaagagctacaccaaattaatcaccttcataaaaatrtaactatagctgctgtgaagaacaatttcatgaggtctctctgggaagcagtcccaatgagttcatcgtctgttacagaaccttttgagtgaccaaatatggagaaactaaatctcacctctggtatttatatattgtggatagtttttttggctactgacgggaatcagcagcttatatttgacatatatctgtgttcatatgcactgcatgattaatatttaaaagttaagaataaatggctcagatgcagtggttcatgcctgtaatcctaatggtttgggagactgagatgggagg

SEQ ID NO: 80983 - DNA, 601 bp, Human
ttttgagatggagtctcagtctgtctcccaggctggagtgcagtagtggcatgatcttggctcactgcaacctccgctttccgggttcaagcgattctcctgcctcagcctcccaagtagctgggaacacagtggcgcatcaccattcccggctaatttttgtatttttttgtagagatgtgctttcaccatgttggccaagctggtcttgaactcctgtcctcaggtgatccacctgcctcagcctgccaaagtgctgggatcacaggcgtgagccaccacacccaacctagacttcttrttgattcaatctcactactcattatgttcaagttttctatttatttctgattcaatcttggtatgttgtatgtttccatttcctctaggttttacagcttgtccttataagttgttgataatagtctctcatcttttttatttctgtggtctcatttgtattgtctccattttcatttaaattgtttgggtcttctcttttcttggttagtctagctagtggtttgtcaattttgtttatcttttcaaataaccaacgttttgttttgttggtcctttgcattatttatttgcttattta

SEQ ID NO: 80984 - DNA, 601 bp, Human
tatgtatatgttagtacttttttgggtgtcccacaagtctcttaggctccgtttatttttcttcattcttttttctttctctttcttagactggataatttcacttgacctatattcatttttactgattcttttttttttggagagggagactcactctattgcccaggctggagcgcagtgccgcaatctcagttcgctgcaacctctgcctcctgggttcaagggattctcctgcctcagcctcctgagtagctgggattacaggcacacaccaccacgcccggctaatttttgtggkttttttttaatagagatggggtttcaccacattagctaggctggtctcaaactcctgaccttgagatccgcccacctcggcctcccaaagtgctgggattacaggcgtgagccaccgcgcccggccatttttactgattcttatgcccactcaaatctgctgttgagcccctttagtgaatttttaatttcatttgttgtacttttcagttctaaaatttctatttcttttaaaaaaatttctctctttattgccatttcctgtttgttgcatactttgttctcttgattttcttgagtt

SEQ ID NO: 80985 - DNA, 601 bp, Human
tcctgggttcaagggattctcctgcctcagcctcctgagtagctgggattacaggcacacaccaccacgcccggctaatttttgtggtttttttttaatagagatggggtttcaccacattagctaggctggtctcaaactcctgaccttgagatccgcccacctcggcctcccaaagtgctgggattacaggcgtgagccaccgcgcccggccatttttactgattcttatgcccactcaaatctgctgttgagcccctttagtgaatttttaatttcatttgttgtacttttcagttcyaaaatttctatttcttttaaaaaaatttctctctttattgccatttcctgtttgttgcatactttgttctcttgattttcttgagttctctaaacatatttaagacagttgatttaaaatcatagcctagtaattcccctagtcattcaacaggagaagtttctgttaatttctttttttttttttcctatgactgggccatattttcttgtttctttgcatgcttagttttttgttattgtcattaaatactgtacattttgaatattatgatgggcaaaaaggaaaaaaataagaaaa

SEQ ID NO: 80986 - DNA, 601 bp, Human
tatcctattgtggtctgccctacttatgtactatcctgaggccaatgtgaattctggaaattattctatactataattcagttctcagtattttttttctgtgtagattctggttcgttttatgtaggggttatttaggatttcataaacagatgtaaaagattcttgtctgaaggctcctcttctctgattctcccttatctcttcttgggatgacttaagtgcagggtgtggaaagttaacagagcaacccactgtgtgtgcagctgccatgctggttgagatcagaaatgacatcctktctttgcttatgtttgcttggtgtcagttggggctagctgacaaagcttcctctctcagtctttccaatagcagtacccgattgggaggtgaggactctgctttgcctgcttttcttattgttggcagtgatggttgacaggcttcacacctcagcctctgtggctaaagtgcctgattaggagtgaaaggggcacagctcctttttggcattggggttcccttctgccaggcctgtttcttctcattttgcatgatctccgttggttagagggaatggtctttcctggggccttttggg

SEQ ID NO: 80987 - DNA, 601 bp, Human
gcagctgccatgctggttgagatcagaaatgacatcctttctttgcttatgtttgcttggtgtcagttggggctagctgacaaagcttcctctctcagtctttccaatagcagtacccgattgggaggtgaggactctgctttgcctgcttttcttattgttggcagtgatggttgacaggcttcacacctcagcctctgtggctaaagtgcctgattaggagtgaaaggggcacagctcctttttggcattggggttcccttctgccaggcctgtttcttctcattttgcatgatctccrttggttagagggaatggtctttcctggggccttttgggttattgttgttgttaatgtaccctttggtaattctgggttgcagtttgctcctgtgtacagactgggatatacaggaggcaaaaataaatcctaaggaattcttttccaggtcctcccttgattcctgaagactctacctgtcctgctttcttcattccacatttcagagtttctgatgtttgctttatgtgctgtgttcatggttttaaattatagttaacggaagcattggggtggaatatgcttactctatcattactg

SEQ ID NO: 80988 - DNA, 601 bp, Human
ttttattaaggctggatcatattccattaaatgtatgtacattttgcttatccattcatttgctgatggtcactggttgtttttacttttgggctattgtgaataatcctgctgtgaacattagtgtactgatatctgtttgcacctctttcaattcttttaagtgtaatgatatacctggaaatataattgctggatcatatggtaattctatgtttaattatttgaagaaccgcatactcttttccacagtgcttgtaccattttacaccagcaaagcacgagtacttcaatttctctrcaactactttaatacttgttattttctgcttttttttttttttttggctatagccaacctaatgggtaggaagtgatatctcactgtggttttgatttacatcctcctaatggttagtgatgttaaatgtatttttatatgctggttggccatttgtatatctttgaggaaatgtctgtgcaagtccttagcccatttttgaattgggttgttttttgttgttgaattgtagagttctttatatattctagatattaatttcctcttaaatatatgatttcaaaatactttctctgggtt

SEQ ID NO: 80989 - DNA, 601 bp, Human
tgaacttttcattatttcttataagcatattggttttggcctgcttgagtttaaaactttttttggtagacttagaatgttaatatttagataaagaaaatattttactgaagacattaccagaaagtaaaataacttgaacatttctgtattagctctttatcagagaataacatttattttatttggaaagttttcctaaatatgagactatctgctatttctcagactaagtgaaaaatttaataaaatagctgccttgataggaggaaaacaaagttcttactttataaggaataaygtatgaatcataaaagaagaatgagcgatcatgggaaacatttagcttttcaaagtttttggaacatgtaccttaaatgcttttgggatccagtaaaggccaggaaaggcaaagagttgaaagtttcttggatttatcctcgtacttacatcattagtaataggaataatgcatctcaaatttgggcatttatataaaaacatgatttttaaatggtagtctagtataaactaggattttgtaatgctgtttaaatattttcatattactttgtttcgaacgtagacattcagtcttact

SEQ ID NO: 80990 - DNA, 601 bp, Human
aaggcaaagagttgaaagtttcttggatttatcctcgtacttacatcattagtaataggaataatgcatctcaaatttgggcatttatataaaaacatgatttttaaatggtagtctagtataaactaggattttgtaatgctgtttaaatattttcatattactttgtttcgaacgtagacattcagtcttactttttacttattatatgtaagattttgaacatccttgcttaaaatattaaattccttcaaaatgagatacaaggttaatattaaaccaatacttaagttcctttacwcattgttgagacagactattagtgtaggtgtactttcatttatatgttgtaccaatagaggttaaaagtatgaccctatcggtaatctttttaagcaaataaaactgtttggatgctttcccaggacgattggattgccctccaggcgtatctcttcaatgcggtcccggatgtaactggtgtcattagccttgcagaatgtgtcatctgtaattgaagctatgttgttgaactgaaaaaaaacgaggaaaacattgttcagaaatctgaaatcaacctttcatatgctatataatgggt

SEQ ID NO: 80991 - DNA, 601 bp, Human; identical to SEQ ID NO: 80955

SEQ ID NO: 80992 - DNA, 601 bp, Human; identical to SEQ ID NO: 80956

SEQ ID NO: 80993 - DNA, 601 bp, Human; identical to SEQ ID NO: 80957

SEQ ID NO: 80994 - DNA, 601 bp, Human; identical to SEQ ID NO: 80958

SEQ ID NO: 80995 - DNA, 601 bp, Human; identical to SEQ ID NO: 80959

SEQ ID NO: 80996 - DNA, 601 bp, Human; identical to SEQ ID NO: 80960

SEQ ID NO: 80997 - DNA, 601 bp, Human; identical to SEQ ID NO: 80961

SEQ ID NO: 80998 - DNA, 601 bp, Human; identical to SEQ ID NO: 80962

SEQ ID NO: 80999 - DNA, 601 bp, Human; identical to SEQ ID NO: 80963

SEQ ID NO: 81000 - DNA, 601 bp, Human; identical to SEQ ID NO: 80964

SEQ ID NO: 81001 - DNA, 601 bp, Human; identical to SEQ ID NO: 80965

SEQ ID NO: 81002 - DNA, 601 bp, Human; identical to SEQ ID NO: 80966

SEQ ID NO: 81003 - DNA, 601 bp, Human; identical to SEQ ID NO: 80967

SEQ ID NO: 81004 - DNA, 601 bp, Human; identical to SEQ ID NO: 80968

SEQ ID NO: 81005 - DNA, 601 bp, Human; identical to SEQ ID NO: 80969

SEQ ID NO: 81006 - DNA, 601 bp, Human; identical to SEQ ID NO: 80970

SEQ ID NO: 81007 - DNA, 601 bp, Human; identical to SEQ ID NO: 80971

SEQ ID NO: 81008 - DNA, 601 bp, Human; identical to SEQ ID NO: 80972

SEQ ID NO: 81009 - DNA, 601 bp, Human; identical to SEQ ID NO: 80973

SEQ ID NO: 81010 - DNA, 601 bp, Human; identical to SEQ ID NO: 80974

SEQ ID NO: 81011 - DNA, 601 bp, Human; identical to SEQ ID NO: 80975

SEQ ID NO: 81012 - DNA, 601 bp, Human; identical to SEQ ID NO: 80976

SEQ ID NO: 81013 - DNA, 601 bp, Human; identical to SEQ ID NO: 80977

SEQ ID NO: 81014 - DNA, 601 bp, Human; identical to SEQ ID NO: 80978

SEQ ID NO: 81015 - DNA, 601 bp, Human; identical to SEQ ID NO: 80979

SEQ ID NO: 81016 - DNA, 601 bp, Human; identical to SEQ ID NO: 80980

SEQ ID NO: 81017 - DNA, 601 bp, Human; identical to SEQ ID NO: 80981

SEQ ID NO: 81018 - DNA, 601 bp, Human; identical to SEQ ID NO: 80982

SEQ ID NO: 81019 - DNA, 601 bp, Human; identical to SEQ ID NO: 80983

SEQ ID NO: 81020 - DNA, 601 bp, Human; identical to SEQ ID NO: 80984

SEQ ID NO: 81021 - DNA, 601 bp, Human; identical to SEQ ID NO: 80985

SEQ ID NO: 81022 - DNA, 601 bp, Human; identical to SEQ ID NO: 80986

SEQ ID NO: 81023 - DNA, 601 bp, Human; identical to SEQ ID NO: 80987

SEQ ID NO: 81024 - DNA, 601 bp, Human; identical to SEQ ID NO: 80988

SEQ ID NO: 81025 - DNA, 601 bp, Human; identical to SEQ ID NO: 80989

SEQ ID NO: 81026 - DNA, 601 bp, Human; identical to SEQ ID NO: 80990

SEQ ID NO: 81027 - DNA, 601 bp, Human
accggagcgatgcagctacaagccaaggaaaaacgcagccctgctgatatcctgacttccaacttcttgtctccagagctgagataaagtaatctcctgttgttttaggccccccagtttgtggaaaactcatgcagtccttctatcgttcatctggacaatggcaacagccttctaccagtctccagtgtctaagcgccaacagtccacatcatcagaagcaccacccttctagacatcgtgtgctcgccaggctgtatgatggctacgagataaaatgtgaattccttagcctggcacrgggctcgccgccatctgcccttggcaggcctttttacctgtgctccgcctctcaccgagtcctcttggcctgaaataccctcagcccttcctcctccacctcagtgactccccaacccttccggtggctcatttgggatgcgtttgctctgctgtgaggcacatccgactggccaacttccttttcctggctcccaagaaaatcgagttgtctctagcagatgaatgatgataatatagaagaacagatcatgtccacccccgcccccgtacaaattacagcacccctgcctgcagtccc

SEQ ID NO: 81028 - DNA, 601 bp, Human
tttgtgttagataggctagttccttaaagacacaaaataaactacaagaaaggctgatcttgagttagaatcaaattgtcacaatctgacagttataaagatgttagctgactgtgtgtgtgcacgttttaagagttcagcttttctttttgagacaaggtctcacctgagtatagtagggtgatcacatcccactgcagccctgaccccccgggctcaagtgatcctcccgcctcagcctcccaagtagctggggctacaggtgtgcgccaccacaccaggctgatttttaattttttttgtagagacacggtctccctatgttgcccaggctagtcttgaactcctggcctggagtgatcctcccactatggactcccaaagtgctgggattacaggtgtgagccacggtgcccagccaagagttcagcttttcactgatcatgttacaaaagaggtttcttcaaaaagattaaagcccatgtcctaagtagatccctcagatgcttctttccttgcttgcacttccttctgctcagctggggcagcagtggaggggcaggactgcctacaggtacaggtccagcagcccccatgctgc

SEQ ID NO: 81029 - DNA, 601 bp, Human
gtgttttgtgttagataggctagttccttaaagacacaaaataaactacaagaaaggctgatcttgagttagaatcaaattgtcacaatctgacagttataaagatgttagctgactgtgtgtgtgcacgttttaagagttcagcttttctttttgagacaaggtctcacctgagtatagtagggtgatcacatcccactgcagccctgaccccccgggctcaagtgatcctcccgcctcagcctcccaagtagctggggctacaggtgtgcgccaccacaccaggctgatttttaatttwttttgtagagacacggtctccctatgttgcccaggctagtcttgaactcctggcctggagtgatcctcccactatggactcccaaagtgctgggattacaggtgtgagccacggtgcccagccaagagttcagcttttcactgatcatgttacaaaagaggtttcttcaaaaagattaaagcccatgtcctaagtagatccctcagatgcttctttccttgcttgcacttccttctgctcagctggggcagcagtggaggggcaggactgcctacaggtacaggtccagcagcccccatg

SEQ ID NO: 81030 - DNA, 601 bp, Human
ctcctctggcttgctttcccttcaggttaagtatgatttctaataattttgtcttatcctacacctaactcgtttcagaataccaaagcggcacatcatctgaccactgtccctgcacatcatctgagccagcatcccagcatgattttaagtttcttctctccagcattaccttgtgcatttctgtatactcttcaagtcttctgcatgctctgctctgtcaaagcacagctaattgtgtatatggcatgtagatatgatcattttcaaagagagactttcagtattgaagtccctactygcaactgagcggctagtaaaagttaaaataagtatatgcgtgtgcacacacacgcgcacacacaaatcatatgccaaaaaacatgatttgtcaagtcaaaaaaaaaaaagttaaagaggtcaaaaagtagtaaagaaagaaaagagagccatctagataagttctataggactgaactatctttgaagaactagctcctggctggttgttcaccttctatgagtttctatgattggcaccttacttaatctgatacctgctcgcttagaaagccaaatgaagacactacgttgatgggat

SEQ ID NO: 81031 - DNA, 601 bp, Human
agtgggcatgtcagtcagtactcctactgtcctaaggggactggggctggacagcaggaggagtgctccgctgcagagctgtgactggacccatcctttctaccacacaggccacacctgctccctcccctcagccacctaaggggagctctggcacccatccacgactctccagggggccagggttctagtttgctttttctgctccagatggtctgagagggggaaagtagagggcaggaagttaacaccagagagcctggtgcaggcggtaagggccaagagatgcaggggagagccrgccaagagatgcaggggagagccggccaagagatgcaggggagagccggccaagagatgcaggggagagccggccaagagatgcaggggagagccggccaggctgaggagcacatctgcaaggcaggctgtcctttctactggcccagataccatgccctgggctcttcctctaggaatctcatgcttagtgaaaacacatgggaaagcagagagctgggacaacagaaaaaactcctgggggattctacacaataaaaggcaccaactttcttcttattggtctttgaatccaaattac

SEQ ID NO: 81032 - DNA, 601 bp, Human
ctagcacaacaggaacatctaaatccacacaaggtgtgacggtttgcctaaaatttcattttatttttcagacagggtctcactctgttgcccaggctggagtgcaatggctgatcttggctcactgcaacctcggcctcccaggttcaagcgattctcctgcctcagcctccagagtagctgggactacaggcatgtgccaccacgcccagctaatttttgtatttttagtagagatggggtttcaccatgttggccaggctggtctcaaactcctgacctcaggtgattcgcctgcctyggcctctcaaagtactgggattacaggcatgagctaccacgcctggcctaaaattattttaaataattgtataatcatgcctattttaataatgtcatgatttaatgtccctactttgtcaattgttacacaaaacaatcaacagagtcattttttccgaacacctacagtcattcaggataaggtaacagatatctggagcacctgaccctctaaagatttttaaaaggaaggcatggacagatcataatgtagttccaggacaaagttaaataaagcaaatgaaatcaagcaaaatct

SEQ ID NO: 81033 - DNA, 601 bp, Human
aaacacttcaatcattcttcaccctgctaaggagaggaaattacacaaaggcgtccaccagatgctgaagaaggctgtggctgagggactgctgcagcgctacttaacaagggatcaggggacaaaagaaagctgctgaacacagctgatcaacagcaacgtgccatatgaaaagagcatcctcacactgtcattagccacacggattaactacagggaccacacaggtccatggaggtcatcatagagccaatcatgagaggactagttatcagaaagaatcaaaaataccaggagtccytcctacctttaacttatgcgactagcacaacaggaacatctaaatccacacaaggtgtgacggtttgcctaaaatttcattttatttttcagacagggtctcactctgttgcccaggctggagtgcaatggctgatcttggctcactgcaacctcggcctcccaggttcaagcgattctcctgcctcagcctccagagtagctgggactacaggcatgtgccaccacgcccagctaatttttgtatttttagtagagatggggtttcaccatgttggccaggctggtctcaaactcctga

SEQ ID NO: 81034 - DNA, 601 bp, Human
atgaaacaccatgtttccattaacagagtaccttgcaaaacaaggactgcctgtacttgaaattccgtttaattgccttagctataggaacagctcatgttaacaaggcaaatatttcaccttgtctttatcagtttgtaaatacagaactgaatgcaagtgccaacatactctgatcgcttctgggacatggttatggagtgcagcaccttcacttttctagtgaacaataactcaggttaaacaacaacaacaaaaatggtgtttctgggaagaaggctttatagcctgaagctatggmataattcttccacaagggggaaattctaaggaaaaatgaacatgttgcagaggaatttgtaacagggtgccaagcatgcagacatacacatgtccagacataagaagcagatacatgttcccactgggagctgttccagccgcacctggaggctcagccttgactctctgacttactagctgggaggtctcaggcacgtcccacgttaagcaattgcagtcaagttgaattcaataatgagacttaaatcaagaatgagatttcaatcagcccaggtatgtgtgttgctaagaatgcccc

SEQ ID NO: 81035 - DNA, 601 bp, Human
ctttcctgtataaattacccagttttgggtatgtctttattagaagcgtgaaaacagactaatatagaaggccacactatagctgggaatgtagggtttctttgccaaagtttataagaactgaaaatcaaagagcaagaaataactactaaattctaataagaaatgacattggctattattaaaactaaatgacagtgtgtgctcctaaatcactcggtattcctggcatcttgcaatctgataaaatggcacgtacacgaaaggttcaataaaagcttacagaggggaattgagtccyttggtgtgaatctgtttctttacctacagaatcagtgactggattctgtgtctattggcttctgcttccgtatatcgtgcattgatagcctctgatttgggtgtggggacaggggaggagtctgtgttctcaggctgggaatgagaccttgaagtcaacacagcagctgctacctacagcctcaattcaggaagggaagaaacgtacaaatgaggacaagggaggttttcagaagagagggcctaagaagtggatggataaaggaggttgctggctgcagacggcatgtgaggagagaga

SEQ ID NO: 81036 - DNA, 601 bp, Human
ctggctcactcgccgctcacttcctgctgtgcgccctgcttcctaacgggccatggagtactggtccatggccaggggattggggactcctgttttagaggatgcaataaaacatatatggagactgcaattttttggtttacaacttcggggaagttaaagggccaaaaccagcactgctataaagattaagctattagatgttttttgctggaaagtatttccagagacatgagctttttccataacacatatcaatcacacacacataaacacacacacgtgtgcgcacatgcatgcrcacacacacacagtgctgattaaatgaagttttgttacattttccattgtcatacaagtatctgcctttaaaagggaaatagtggaccagggattcatccatcatattttctccacacaaagcacagggcacagtgccatcctggaatttctccagccaagcataaagaagatatctgaaggcaagacatatgaagagtaattatgagaggacagaacttcattctgttctgagatttgctgtttttctctagcatttagtgaaattatttcttcacttctctgcatttgacagagtgca

SEQ ID NO: 81037 - DNA, 601 bp, Human
catgctggaaccttctttctagagagctgtgtttggagaacggcacacagagccccttgactcctgggcctccagcatctcccaggaagacctccaatagtatgtgattaaactatagacatgcagctcaaataatactctggatgagccacagaacatgtcttcttttctacagaaaacgtattttcttaacccttgaataagctagggatacaagatccattcaaagtttaaggctcggtaatagatttgaagatacacgaggaggaaaaggttactgatagggcttcaatttccacawagcaactaactcttaagaaactatcacttgctgaattctggtgtagtaaaacagctacacacagaaatagagctaaagaaagaaaaatagttaacattatcttaaaagacttaaaatatcccttccttttcaaactaggttctatataagagacgtgatctcagctcactgcaacctcctcctcctgggttcaagtgattctcccacctcagcccccctgcccccaaaccaaaaaaagaaaaaacaaaaaacaaaaaacaaactcgggcttctcattctcattagccacttcttctgggg

SEQ ID NO: 81038 - DNA, 601 bp, Human
tcgtgattaaatgagctggtggatgagccaatgagctgtctgtgtggtgagcacgtggcagctggcaatgcagaggcctctcttcggtcctctccttggtcctttccatactgacacccgttgtgcatggcccagcaacctactcaacaggggatgagaggcctacaaagccaatgcccttcaggatggatttattttctggttttcacagggatgccctcagttctccttcctgcaaatatagtaactgctgactcctgaaataaaagccggtgtttatagctgtggttgcaaagtcagygtttcccaaacaaagatgtgttgcagtaccaggtgaggcttatgttgttttcactggcctcccatgcccatattaacgttcaattctaaattgtctagtagtagaatgttcatggggtaaggggtttctagaatgttctgtgacacagcagtccagagaaattttccagaaaaaggagattcctcccattaaatgaggaactggggacctgccatgtacaattagcacagaaatgtttccagaagtgctgccatggataactgtgtagttgaaacctcactgaggcctctcaggcatgga

SEQ ID NO: 81039 - DNA, 601 bp, Human
gtgaaatgtggactggggtagaggaagagatggattatcccctggggtaacactgcttggctaaagttgtgaaagcagcttttattctctatttgcgtgaggctgcttccaaggagcaagacaggtgtgtgggacgggaaatcagtagctgactgtggctgttcccaaagagataatggaaggcacccaatacacctgcactcacctaaagggggtcatacagttttgctgtgtccctactcaaatctcatcttgaaatgtagctcccagaatccccacgtgttgtgggagggacctggtrggagacaattgaatcatgggggcagttttccccatactattctcatggtagtgaataagtctcacaagatctgatggttttataaggggaaacccctttcgcttggctcttattctctctcttgcctgctgccatgcaagacatacctttcaccttctgccatgattgtgaggcctcctcattcatgtggaactgtgagtccattaaacctctttttctttgtaatttacccagtcttgggtatgtctttatcagcagtgtgaaaatggactaatacagggggtctgcagtggagggaaa

SEQ ID NO: 81040 - DNA, 601 bp, Human
atgacaaggccttgctgtgatttttcttttcctcactgggtagaattggcatcatgaaagatgtatttttcagccatcaggggagctcattgttaacaaaagtcacaccaaacccaactatgaactctttggtaatttgaaaagtggagtggcagctgcctgtttgggattttgtattaccagttctaagatggttgcccttcctgtgttaacttaccaaaccaagtgacgatggtgctacaggcagtcccaaacaacatggagcagaaacaatcagcatctccttcagacccatgggtcyggtccatctgactgtggagggctaccttggtgatctggaagaatctgctgacctggtcccttgaccttgtagtcaaatttgactagctaaagttctgccagacagctcttcattttctcactgggcccccttcattcaccccaactttctggtgaagacagcagccctgatccatttttccaggagtaaactattatcttaaatacagttcaagtctccttggttgacagacaccataaatatatatgatctcattaggaagttaggcctctgtgcttcctattaaaaaataacaaaaac

SEQ ID NO: 81041 - DNA, 601 bp, Human [sequence omitted]

SEQ ID NO: 81042 - DNA, 601 bp, Human
ggaggaccccgattgaccagaaggacatggtcaggagagctcggcaggggtttttctgcttagtacacgttatagagtcttagctatggaagagctctagggggaggggaagaaccctgaggtgtagtcctgggttgagtctaaactctgttacttcctatctgtgtgaccctagagaaaactttctgctcctcagttgcatcatctgtgaaatgtgactgataatacccaccttaaggctgtgagccttaaacaaggtaatgtgggaaatgcctagcacagcgtctggacatactaaatkctcgatacaatagcatggacctcagaggcagctgtggtgtcatttgttagtattttatgccgaacctgcgacctccaccattctctttgattgggtgagagtgaataagggtgtctgaggcagtgttgctgacttcttcccttggaagaggagaagtcatggggtctgggagctctttgacattgaggtttgtaggaagtgtgtgctgggggaggcttgctctgctgagcacagaagcaagatggtctgctggggagtgtggagcccgagccagccagacctgaacccacaccctcactc

SEQ ID NO: 81043 - DNA, 601 bp, Human
cggagctgatgaaccccgagcacaccagctcacttccaagtcccaggagggcctactggaacccatgcaggatccgggctggatggctacaggttccatctgagcagcacggactggcgtcaccacagccctgggcatcctgcctgccaaaccctggtctctactctgctacacacaggatgtgtgaaatggaactctctccttcctttcagctgtaatgggtggggggcagggggagcaggtagcctgcagggttgacccctgggggtttgcatcttttctgtccaggatgatctattcaaaccttttctagccccaggacccattaggcatctgtacagagcttccaggctctgaatgtgcagttttgagacgttgcccctttctagacatatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaa

SEQ ID NO: 81044 - DNA, 601 bp, Human
agctgatgaaccccgagcacaccagctcacttccaagtcccaggagggcctactggaacccatgcaggatccgggctggatggctacaggttccatctgagcagcacggactggcgtcaccacagccctgggcatcctgcctgccaaaccctggtctctactctgctacacacaggatgtgtgaaatggaactctctccttcctttcagctgtaatgggtggggggcagggggagcaggtagcctgcagggttgacccctgggggtttgcatcttttctgtccaggatgatctattcaaascttttctagccccaggacccattaggcatctgtacagagcttccaggctctgaatgtgcagttttgagacgttgcccctttctagacatatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaatgg

SEQ ID NO: 81045 - DNA, 601 bp, Human
gttccatctgagcagcacggactggcgtcaccacagccctgggcatcctgcctgccaaaccctggtctctactctgctacacacaggatgtgtgaaatggaactctctccttcctttcagctgtaatgggtggggggcagggggagcaggtagcctgcagggttgacccctgggggtttgcatcttttctgtccaggatgatctattcaaaccttttctagccccaggacccattaggcatctgtacagagcttccaggctctgaatgtgcagttttgagacgttgcccctttctagacayatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaatggtaattagtttcgatctcagggtaaagccatatggagcagcgtctgggatgctgtttaccttgcggtattacactgtacattaaaaatca

SEQ ID NO: 81046 - DNA, 601 bp, Human
tgaaatggaactctctccttcctttcagctgtaatgggtggggggcagggggagcaggtagcctgcagggttgacccctgggggtttgcatcttttctgtccaggatgatctattcaaaccttttctagccccaggacccattaggcatctgtacagagcttccaggctctgaatgtgcagttttgagacgttgcccctttctagacatatgtgtctcaggctcagcctgccctaacacctccccaagccccagtttctttctgccctttgcaggatgaagggactgatgtctgggaggattgaaaccacgaaaggagcttgttagcacgtggcagtgttgacctcaggggtggtctgatggcgaatgtgctggacagtaactcccttattgccccaacctggaaatatacacagaatggtaattagtttcgatctcagggtaaagccatatggagcagcgtctgggatgctgtttaccttgcggtattacactgtacattaaaaatcagctgctctctcctgagagccgagccgtctcccgcctctgcagactgctggttaaccccaagaagctgaacggagccctgcaggttctgggtc

SEQ ID NO: 81047 - DNA, 601 bp, Human
ctcccaaagtgctgggattataggcgtgaaccactgcgcccggccaatattttattttattttttgagatggagtcttgatctgtcgcccaggctggggtgcactggcatgatctcagctcattgcaacctctgctgcccgggttcaagcgattcttctgcctcagcctcctgagtagctgggattacagacaggtgccaccatgcctggctaattttgtgtttttagtagagatggggtttcagcatcttggccaggctgatcttgaaccgcgtgatctgcccgtctcggcctcccaaastgctgggattataggcatgagccaccacgcccggccgcgcccggccaatatttcttttgaaattcactgggagttataattttactaccagttcaatatgaattaacaggtggtacggctgtaaaaaatactaaacagtcttaggatgcacaataataataaaaataatagcagcaatgatttcagaagtgcctattatgtgccaggcatgttccgtcaaatactttatgtaatttttgcagggcattcattattttcctccttttagagatgaggatgagacatataaattgttagtcc

SEQ ID NO: 81048 - DNA, 601 bp, Human
gtgagggcctaaaggggccaggacacagaatgcccaggctttcaataggtgatattctcaataggtgatagaggtgaagggtgtggcacctccctggaaaggagcacagctgcggtcaccaagtgaggctgtggcctccatcgtaaaggccatgtggggcggcaagtgaccgaccacagggcacggtaagtcagcagggagcgaccaccaggattccttaccaaagttggattcctcagtctctgctatgctaccctcagagattcagattcaattttttgttttgttttgtcccgctctrttgcccaggctggagggcagtggtgtgatcttggctcactggaacctctgcctcctgggttcaagtgattctagtgcctcagcctcccgagtagctgggattacaggcgtacgccaccacaactggctactttttttgtgttttttagtagagacggggtttcaccatgttgcccaggctgatctcaaactcctggcctctaagtgatctgcctgcctcggcctcccaaagtgctgagattacaggcacgagccatcgtgccggcccccgattcactttttaggaggggacatctgtgtc

SEQ ID NO: 81049 - DNA, 601 bp, Human
aggtgaaggtgtttggtcatctctgaggtcgcttcctgctcccagtgtcctctgactccaggatagagtcatgccccttggcgggcagcccggtgggagctgtggtgtgtaggaggcccggacggcggcccctgcccacatgccatcacctcccagctccgtctccacaggagcttacccaggctgactcacaggtgctgtattatttaaggaaagttgtttattgattgttggggcctggaaataaaaagaaaaacaaagaagcagatgcagagtgtctccttgccacctccctctgggsgcctccgagatggtggctgaggaccaggccccactctgggtgaggcttcctttccgccactggtgcttccctttgtctctctgcagcctgggcctgtgctttgggtttagttttgcaacatagtcatgctgaaggtcccagagatgcttcccctttttattgtaattaagccaaaaaagaaacatggggtatgtaatttagaactactcataaccacagagatggaaggaattttctctttaaagctagcactagatttcaccttgcaccctaggccacttgcccatgtccttgccatct

SEQ ID NO: 81050 - DNA, 601 bp, Human
aaatggcatgtaaaagcaatagagggccaggtgcggtggctcacgcctgtagtgccagcactttgggaggccgaggtgggcagattgcctgaggtcaggagtttgagaccagcctggccaacttggcaaaacctcatctctactaaaaatacaaaaattagccgggcattatgacgggcacctgtagtcctagctactcaggaggctaaggcaagagaatcacttgaacctgggaggcggaggtttcagtgagccgagatcttgtcactgcactccagtctgggcgacagagcgagacttsatctcaaaaataaatacataaaaataaaagcaatagagtattacagtgtgaatcaggaaatcttgcacgttttgaaggtttcaaatgacttggtttaataaagaaagaaaacttgtaatacctagaaaattgacgttgaatgggaaaaataaaacaaaatattgctatacaaaaacctcttgttacattcctgactcaatctgatatttgtgtttggtttatttgaatacataaaatatattatggccattggtgagtagttagttcattttgattcaagttacttctccagatggcatc

SEQ ID NO: 81051 - DNA, 601 bp, Human
tggtttaataaagaaagaaaacttgtaatacctagaaaattgacgttgaatgggaaaaataaaacaaaatattgctatacaaaaacctcttgttacattcctgactcaatctgatatttgtgtttggtttatttgaatacataaaatatattatggccattggtgagtagttagttcattttgattcaagttacttctccagatggcatcattgttataaaatttaatttccgtgaacttacattcttccaggatggttgtgtgtgttgatcttctggtttcttaaatcttctgggtcagagttactatacttgcatttgtgcttcgcaatgaactagaataaatactttctattaaaaccagcagaggttttgctaaagagaatgcacgcacaggccttgtctttttggtgcaaggtagagggttttatctactacctgcgactaactagctttcagaaaagagtgaactaacgctttacccatggagttcacaaacgttcatggtgtactggcagtagggatacatgtacaagcatagcttagttcctaccttctagggattcgaagtttagtagaggaggcagattgtaatacctaat

SEQ ID NO: 81052 - DNA, 601 bp, Human
ttcagttgtgtggggctgctctgtgtactgtaggatgtttagcagtatctctggtcagtagcacctccccccatttgtgacaaccagatgtctccagacattgccaaatgtcccccatggggagaatcgcccctgattgaaaagcactgctctagagcctgctcttgtgcccaccactctgtactgtcttcccagatgagtgaatgctatgggagagaataagcatgtttacagtgtgaagtcccaattcctgctgacagcagaggacagatgccaacactacctagggtggtggagaagagaaatattctcagatatggtgccattggagttgaattttgaagggattcacgtagtcagagaaaaaggaagactatctggagtaaagggatgtgtgtgcacaaaagcatggcagcaggaggaagcagggcaaccttgaggatgacaggtagttttctatagaccctttaatttactcttcagtgctgttctcttgtttcctctgttcaaacagcaagccagggttacagcagctcttcatgtcattcttacttcaaatcaaaggtgttgtgttagtcaggatgagctaggttatgttgca

SEQ ID NO: 81053 - DNA, 601 bp, Human
gcatgcatgtatgggtgtagatatgtgggtgtgtagataagtgtgggtgggcacatgcgtacacccactggaggggtgcgatggaagttgtgtgcagctgcgtgagcgttactgaccatcctgtggtttgctgatagctgcttaatctgggttgtgtgtttcctccctccccaagcagacactcagggtgctccgtgatgcaccgggacgctaatattttcacacctgcaatctgtattgttcttttctccttcggagagcaatattgcccttctgggtgcttaagcaggaaacacaggaycagataatttaagaggagccttaatgctcagggccagaacagacagacgggcctgaacaaggtcacaggccgtccagggagtgcagggctagggcaatgccagcccacttccttccagccgagcgctcccttcacggtgaccaccttcccttcaacgtctttgtttcccggctgtaaaatgggcatgttgcatacagctatgtaggaagtgtttgcaagtgcccaggctctgggaatttgagtaaagaaggccctttgtcagtggcgcacacagcctcggctttcttcaccttgtcagtt

SEQ ID NO: 81054 - DNA, 601 bp, Human
ggggtgcgatggaagttgtgtgcagctgcgtgagcgttactgaccatcctgtggtttgctgatagctgcttaatctgggttgtgtgtttcctccctccccaagcagacactcagggtgctccgtgatgcaccgggacgctaatattttcacacctgcaatctgtattgttcttttctccttcggagagcaatattgcccttctgggtgcttaagcaggaaacacaggaccagataatttaagaggagccttaatgctcagggccagaacagacagacgggcctgaacaaggtcacaggccrtccagggagtgcagggctagggcaatgccagcccacttccttccagccgagcgctcccttcacggtgaccaccttcccttcaacgtctttgtttcccggctgtaaaatgggcatgttgcatacagctatgtaggaagtgtttgcaagtgcccaggctctgggaatttgagtaaagaaggccctttgtcagtggcgcacacagcctcggctttcttcaccttgtcagttgtccattcaggtggagtagctatgaacacccacttacccttcacgtatcctaggatcaggactgtgcctgca

SEQ ID NO: 81055 - DNA, 601 bp, Human
agcagacaccctagtgggttcagctcaaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacactctctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagca

SEQ ID NO: 81056 - DNA, 601 bp, Human
cagacaccctagtgggttcagctcaaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacactctctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagcacc

SEQ ID NO: 81057 - DNA, 601 bp, Human
ctcaaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacacwctctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagcacccaattgactgagcaccctcag

SEQ ID NO: 81058 - DNA, 601 bp, Human
caaactccagaggggatggggatgggcaacactcctgaggaacttctgttcagcactcgtcatcgccaggacaaatgatgggaggtccaggttgggaggtttccatttaagcgttggttccttgcaatttccctgggtagttttttcaaacaacccatgattgtcattttcggtcggacgatccccattgtttgggactgtccagcacactgaaggtcactgagcatctgggcatctgggccttggagcactatttgccattgtgcaacatacacaacacacacacacacacacacactcwctctctctctctctctctctctctctctctctctttcaaaacaccctctagggctggaggcaggtactgcatctggttaggaaccactgcaaggaattatttaccttggcaacatctcaagaggatatcgaactggagtcaaaggattttggggaggtggagtaggaaggaggtagaggatgttaggctgagaaatgtcctgtcagcttggacatggtgttggccaaatttttttaagtgaagaattttcattttttttgtcctatttatgagcacccaattgactgagcaccctcagtt

SEQ ID NO: 81059 - DNA, 601 bp, Human
acaacccatgattgtcattttcggtcggacgatccccattgtttgggactgtccagcacactgaaggtcactgagcatctgggcatctgggccttggagcactatttgccattgtgcaacatacacaacacacacacacacacacacactctctctctctctctctctctctctctctctctctctttcaaaacaccctctagggctggaggcaggtactgcatctggttaggaaccactgcaaggaattatttaccttggcaacatctcaagaggatatcgaactggagtcaaaggattytggggaggtggagtaggaaggaggtagaggatgttaggctgagaaatgtcctgtcagcttggacatggtgttggccaaatttttttaagtgaagaattttcattttttttgtcctatttatgagcacccaattgactgagcaccctcagttaattggagaatcttgtgcattttgtttggctttgttttcattctttcttaataagaatgtcttaataagatgtctcttaataagcactattacctgtggggccagcttcatgaatgcagttgcacaggccgcatgctcagaagggccct

SEQ ID NO: 81060 - DNA, 601 bp, Human
ggcaggggaggccatctctgtttctggatgttgctagcctggtgcctcgccagggagggggtgcagccagaataaaggcatgagacatactcatgctaaaaagtcacttgttgtttatctaaaatccaaacgtaactgggcatcctgtactttttctggcagctctaacccagaaggcagttttgtcacagcctttgtgaaatgggtgaatccagaaaggagacagctggtggcccagaggcctctggaggtcccctattgaggggccagacgtctggggctctgctgcccactgctgccrcctgcttgctgtaccatctggagttgttctgaggcctggtgtaactcgtgttcaccagtgtcttcttccgtctcccttaggctctcccccagaatggaatacagtgaggggcctggcagaatactggcctagggcagcatggcctgccaggcctgcatcagaaagctgctcaggcttgctgcctcacgagttaagatgctgtcagctgcaagtatcagaaaactgcaacccagtagagttgaacaataaagaaaacacattctttcaccttgatcagtaagtcccagcacaggcagttct

SEQ ID NO: 81061 - DNA, 601 bp, Human
cctcgtggttgccagatgggtgctacagggcctcgtgtcctgtgtggaaatgataatatcccttggaggaaaaaggggatggctcttcatggtgtctaaggccgagacatctttttcagaaggctcccagcagatatcccctgtgtctcattgaccagaatgtctcgagttactcgtgcctaagtcagcctctggcatgggagtggcttataacaattagtattgactctgggagtagctccaaagagcatacatttgggtgggtctcagttaggtcccttgagctgttattctaccaackgtttgaggcaggtttgatttattttttgttctttttggtttttaacaaaaacttaaacattacagagaaagaagctaatgataaccatgactaaataatgataaccacgactaaatgaatgatttaactcattctaggtatttacaatcgttgtaaatccaatttggtctttgatcaattgcctaattttgttttacataattgcaatctgattgtactagttttatcttttattgttttaacgtcatttcatacagtaatcaactgtgtggtctgattcctgagtgtgaactttgagct

SEQ ID NO: 81062 - DNA, 601 bp, Human
tcacagatacaagtctccttggtgggaaattgaaggtattcaggcccgtatgtgcccataggcacatctgcatatttggatttgacccaggaagcttggggaaggagggagaaaatcagaagctttgacatcattttttttttttttttttgagatggcgttttgctcttgttgcccaggctggaatgcaatggtgcgatcttggctcaccgcaacctctgcctcccaggttcaagtgattctcctgcttcagcctcccgagtagctgggtttacaggcacgcgtcaccacgcccggctcrttttgtatttttagcagagatgaggtttctccatgttggtcaggctggtctcgaactcccgacctcaggtgacctgcccgccttggcctcccaaagtgctgggattacaggtgtgagccactgtgcctgaccgacatcaagttgtatgtttctggactctcctctcttcctctggccatcagaatgttctcacatcaaaaatgtgagatgagggataaaggaattagcacctaaatgttttacataatgttaggataattttgctctgtgggagagtggcctgaatgtggggagcctttg

SEQ ID NO: 81063 - DNA, 601 bp, Human
tattcaggcccgtatgtgcccataggcacatctgcatatttggatttgacccaggaagcttggggaaggagggagaaaatcagaagctttgacatcattttttttttttttttttgagatggcgttttgctcttgttgcccaggctggaatgcaatggtgcgatcttggctcaccgcaacctctgcctcccaggttcaagtgattctcctgcttcagcctcccgagtagctgggtttacaggcacgcgtcaccacgcccggctcattttgtatttttagcagagatgaggtttctccatgttggtcaggctggtctcgaactcccgacctcaggtgacctgcccgccttggcctcccaaagtgctgggattacaggtgtgagccactgtgcctgaccgacatcaagttgtatgtttctggactctcctctcttcctctggccatcagaatgttctcacatcaaaaatgtgagatgagggataaaggaattagcacctaaatgttttacataatgttaggataattttgctctgtgggagagtggcctgaatgtggggagcctttgagtaactgacctataacttttcttaggcccttctgg

SEQ ID NO: 81064 - DNA, 601 bp, Human
cattttttttttttttttttgagatggcgttttgctcttgttgcccaggctggaatgcaatggtgcgatcttggctcaccgcaacctctgcctcccaggttcaagtgattctcctgcttcagcctcccgagtagctgggtttacaggcacgcgtcaccacgcccggctcattttgtatttttagcagagatgaggtttctccatgttggtcaggctggtctcgaactcccgacctcaggtgacctgcccgccttggcctcccaaagtgctgggattacaggtgtgagccactgtgcctgascgacatcaagttgtatgtttctggactctcctctcttcctctggccatcagaatgttctcacatcaaaaatgtgagatgagggataaaggaattagcacctaaatgttttacataatgttaggataattttgctctgtgggagagtggcctgaatgtggggagcctttgagtaactgacctataacttttcttaggcccttctggttttatcccagttactgatgctgttcttatctcctatctattctggaattcatctctgaacatttaatacatttggccaagcaagagcaatgctg

SEQ ID NO: 81065 - DNA, 601 bp, Human
catcctttctcccaagccggaagctggcggccagcagcgctgagattcttttcgtaagcagcaacagcagcccccttgtctttcccgcctgggggagcgcaagccaggggtgcaggtcagcatttcaagccccgctactgcctctgctgcgggcccgctagcgctggcgaaggcgacaggggcggccgccttcccgtcacgtgaccggcaccgccgccgagcatgccgggagacggcgccccctccccggccgcgggcttccgcgcgtgggcggcgggcagagcgcgcgcgggaggagagrggaggtgggggccgggcagcgacaggggaagaaaccgcggcgaagaaaagccccctgtagagcaggccctgcttcaccgccctgcccgaaatcccccgccgcgcccctgcctcggccagccagcgtcgggcggtgggaaccgggcctgagctgagggcggagggactccggcgccgtccgttcattgtaaacaaatcgagtgagaaatggaggcacgcctggttcctgggtcccttggtgcaggctttcacaccccgggtgctagcactcggtctttctcctgcgtaggggataggattg

SEQ ID NO: 81066 - DNA, 601 bp, Human
aactttccctttttttttttttttccgagagggagtctcactgtgtcgcccaggctggagtgtagtggcgtgatgtccgctcactgcaacttccgcccccctggttaaagcaattctccctgcctcagtctcccgagtagctgggattataggcgcccaccaccacacccggctaatttttgtattttttagtagagacggggttttgccatgttggccaggctggtcttgaactctagacctcaagtgatccacccacctcggcctcccaaagtgctgggattccaggcatgaaccaccktgccgggccaagttgaacttttctcttgggggaataatttccctgctcaacatagacctggtggaattttcttgtctctctcttccctggcattttctctggtcttaggcaagcatttcctgccttttctgattccctctctgtgtgtgcatgggacttaggggaggaaggaggagggagttttctgttaagggagccgtgaatgagcaggaaatggctatttggtaccagttattctgcagaattagggagtgctgatgctgacaaggagtcagaaggattcagtcatcatgacatctg

SEQ ID NO: 81067 - DNA, 601 bp, Human
ggattataggcgcccaccaccacacccggctaatttttgtattttttagtagagacggggttttgccatgttggccaggctggtcttgaactctagacctcaagtgatccacccacctcggcctcccaaagtgctgggattccaggcatgaaccaccgtgccgggccaagttgaacttttctcttgggggaataatttccctgctcaacatagacctggtggaattttcttgtctctctcttccctggcattttctctggtcttaggcaagcatttcctgccttttctgattccctctctstgtgtgcatgggacttaggggaggaaggaggagggagttttctgttaagggagccgtgaatgagcaggaaatggctatttggtaccagttattctgcagaattagggagtgctgatgctgacaaggagtcagaaggattcagtcatcatgacatctgcagtcacaactgggtgggttagtgagcgcccctgaagtgtgtgtactcatttcaggcgcagccagcagcagaatttgggaagactgtcccacccctcctactccctgtgtgctgacagtttgctgtgtgcgtctccatggctc

SEQ ID NO: 81068 - DNA, 601 bp, Human
tgggaactcagcaatgtgtgtaaagcgcctcacatatatattaaatcgtattaatagctgtgatgatggttaatactgagtgtcaacttgattggatttaaggttgcaaagttctgggtttttttttttttttttttttttttttttgacggagtcttgctccgttgccaggctggagtgccgtggcgtgatctgggctcactgcaatctccgcctcccggattcaagtgattcccctgtctcagcctcccgagtaggtgggactacaagcgtatgccaccatgcctggctaattttttgkgttttagtagagacggggtttcaccatgttggccaggatggtctcgatctcctgaccttgtgatccgcctgcctgggcctaccaaagtcctgggattacaggcataagccaccgtgtctggccagttgcaaagtattgatgctgggtgtgtctatgacggtgttaccaaaggagattagcatttgagtcagtgcactgggaaaggcagacccacccttaatctgggtgggcaccatctaattagctgcgagtgcagatagaaaataaagcaggcagaaaaacgcgaaaagactagactgg

SEQ ID NO: 81069 - DNA, 601 bp, Human
ttcactaatgccacctggggcaggtccccactgtcttcaccactaatcgcctcccttctctagctcccatagttgtggtgaggaaaagtggcttcagtgctcagcagagtgcttgggactgcatcaagcccagttcgcctatcaggtatgtttgatttcagcttattcctcagaagaaatggccagctattgtttgcagagttggagaatcacgcacaaagagattccctcacctgacctctgacacccatctctccagggatgatgagaaggggaaccagggccttccttgctgatgccrgggctgtgtctgcatcacagtgctctcttgtctaaagggggaaattctgtttctcattttgcagcactgtgtattcatgatcttttcagatttgcttattggtgcagaaaggggaaagagtctaaagtttcttgaatctttgccagacactgtactatgcctctgaatgcatcatgccttaatcacgcctcacagcaactattgctactttcatctttcagacaaggaaacaggttcagaaaggctaaccaagttgtgacaggcacctagcctgaatcagtggatttcttcctggaccca

SEQ ID NO: 81070 - DNA, 601 bp, Human
atccgtttcctccccctcctccccgcttccctctcttccctcatcttactgtcttgccccctgggtttggggggctcacagtgacattgtgggccctgccataatttctccacttcccttcttgtcttctcccccgtgtcctctccctcctgtccttcttctcttccctcttgccatctgtcttccaattctgctgcacaccgactcttgctgcggctgccagaggacagagtgaggatggagcagagccacgttctgtaggggagggggaggccccacaggtagtgtcaggtctgcggcmggtgtgagaagagagagaggatggcggggttcaatgctcgggcagctggcctgggtgggagtgtgagagatgcctggactgcttgccctgtcagtgcagccaagattatgttggcatctgtggagtcatgcaggactgccagtctctgggctgaaggttaaccaaccccctttgccaaccttccatacattaactgccataaaatgccatgagtgccagtctcactttgcacaattgatttatttaaaaccaaaatatggaccttcagtcttttattattggttttggcctagaatgtca

SEQ ID NO: 81071 - DNA, 601 bp, Human
ctcatcttactgtcttgccccctgggtttggggggctcacagtgacattgtgggccctgccataatttctccacttcccttcttgtcttctcccccgtgtcctctccctcctgtccttcttctcttccctcttgccatctgtcttccaattctgctgcacaccgactcttgctgcggctgccagaggacagagtgaggatggagcagagccacgttctgtaggggagggggaggccccacaggtagtgtcaggtctgcggcaggtgtgagaagagagagaggatggcggggttcaatgctygggcagctggcctgggtgggagtgtgagagatgcctggactgcttgccctgtcagtgcagccaagattatgttggcatctgtggagtcatgcaggactgccagtctctgggctgaaggttaaccaaccccctttgccaaccttccatacattaactgccataaaatgccatgagtgccagtctcactttgcacaattgatttatttaaaaccaaaatatggaccttcagtcttttattattggttttggcctagaatgtcaatcaagataattttgactcttgatttttgtaatttatcc

SEQ ID NO: 81072 - DNA, 601 bp, Human
tcccagtggctttctttaggaattttcataaagctaaacgtctctccttggagagggctgtgttgatcaccatctgctgaatactctaaagaggtcggagagcaaacttgctcccaagctagtggaactagccagtggaatccagatgtcagtaaagtggggaagcacttgtttgttgggggggaaaatggagtggttggtaatgggagcaaaaagagtccaaatcattttttctggacccttctcccaattcccatccctatccctacccatctgtctttgactttatcagtgagagtcmtaccagcgtccttgggtggttttgtgggtcaggcagagagaagggtacaaagattgttggtggattccaaatgccaggtgaaaggggaaggagaaagtgctagcataaaagctctgcctgggacccggcaggctgctctggcacagctgactgtggcagcagctctgtggtctgggcagcccctgagtagcctgctaattgtgactggcttcattagcattttgggcagtggccccgagcagctgggctgctgctgtcaagagttgctttgcagatggaagacctccttttctgtcctct

SEQ ID NO: 81073 - DNA, 601 bp, Human
cagagtcgttgggtagaggctgcagggaggcctgtgagggcagggtcatgccgtgtgggtgcagacagggaagaacagctactgccctggagcctgctgggaggcccagagctcatctgtggaggctctgtgggagaggggacagtcaataacatctttactgttgagttggacttcagtggctggacagggagggaaagatgattccaagttgaaggtccacgtgagcaatggccaggaaacccgagagaatgtggcgggaccgggaaatggtgagtgggtcaatgtcgccaggacttargggcaggggtggggcagagcgggcatgcgtggagccagggtgctgaacactgagctcagcacgagctgaattttgaagtgccacattctaaggaaattaaaacatcctgtggatggcaagaggacaggttgagttttgaaaggggcgtccgcagatggaggtgtagggaggtagctctgaagacagggactcttggatgaatctcttactgtgttgttcccgttgaagggctgtttccctcttggggcagaggccaactccttcattccccagcttggcttaaatgtctactcaggcatt

SEQ ID NO: 81074 - DNA, 601 bp, Human
gagccagggtgctgaacactgagctcagcacgagctgaattttgaagtgccacattctaaggaaattaaaacatcctgtggatggcaagaggacaggttgagttttgaaaggggcgtccgcagatggaggtgtagggaggtagctctgaagacagggactcttggatgaatctcttactgtgttgttcccgttgaagggctgtttccctcttggggcagaggccaactccttcattccccagcttggcttaaatgtctactcaggcattcaaagggaaaaggaaagcaatggtttttcctkaccccattccactctccccatgtaggacctgtgagttggctgattgtgggttcagcatctgccaccctgggaatgttgacccaggggtgtgaacggtggagcgctggaggcaggcaggggccctccatgatgggcagagcagctcagtggccttggcagatctggactctggtcccacctgtgtgcctctagggacgtctttggggccctctgtacttgggttttgttacctgtaagttatatatgagtgactgcttaaccttctggagtctccatgcagagcaaatgaaagaacatatg

SEQ ID NO: 81075 - DNA, 601 bp, Human
tttgttttgcagggttgccaaaaacatggccagctagtagacctgcatttgctcccttttttagtgcccaggctgaggcatttaaatgttgttgcaggtgggagaggatgaagcacagatccaaatctgcacaatgcaaaaatatgcaaattgggctttaaaagaaaatgtttatatttaatttttaaatcaaaccttttacctcaatataggtatttttctgtatgccccaggcgattgcaggaaagcagcctggcatagggaaatcctgggttagatttgggctctggatttatcaaattttctgcacttaccaactctgtgcccttgccagggtggttgtgaagaccaacttagagaatggacacacaagctgtcttgcataatggtaggctcagagaacacactcaacacatattaattgctttccctgccttctctgcccaattttacagatggaggtgtctgcaatggtaaactttctggctaaatcaaagggaaatgaagtgtaaccccttaagagcaaaagggctggttctaggtgggagtgttattcacaggctaggaagaaaggaacaatctggcctcggaaccagcaaca

SEQ ID NO: 81076 - DNA, 601 bp, Human
tgtggttggttccgtaagctggtcggaggcgcagacgctgggccaaagtgtcagcagcagtaggaaatctactgggtgttgaggctttttgcagttcccttttctccctgccctctccgcctggcctgcgctttaactcttcccgggtttgctgcagggttgggagtgagggcagtttcactggtgaaaaggacgctttcagaagccagactcctaaccttctccccagcaaaatcgaatttagagcaataacctttaagttgagttttaaactgtgacatgtccattacagatcattggrtaaatacagaaaactataaagaaatgaaaatcacccgtagtcacccttttagactttttcctaacattaaaaatactgcttttatttctgcaaaatgtaattttaagtatagtcttgaatgactgatgaggaaaaccttcttttatcgtctttcttctttcaacatcagttcaaaagggaggtagaatatcgacttaggttagtccccacaactcagcttttttgagactatcccaagaacacagcatttcagagccagatagtatttttgagtttatgtggttaatctttccactttct

SEQ ID NO: 81077 - DNA, 601 bp, Human
tatcccagtcctggctccttttggaatagataattctccctttttctctctggccaggactgataatgataataataatgaacacttaggtagtgtttagtgctagacactttacattttaatctacacagtgtcccaaattcatttcacaggtgaggaaaccaatggggcacagataagcttgcctgaagtcacagctatgaagaacagagccagaattcacactcagcctggctccagagaccatgttcctaaccactagactagactaatcagcctgctccaggggctcggcctctgmcctcagtggcagcactctatttgaggtctgcagccatctgcaggggatttgattttcctccccctttagggaaagcaagtctggggtcactgtggctcctttgccctctcctaagtttgcatggcagccagttttcattttgtgtcgttttattttccataggccacatttatcatatttaataaccaaatgttatttggttattggttattttgtaaaattcttcacatgaataacattagaaaaatagtctttgttagcgtccatgtcctggtttggtatttggacaaattgtggagg

SEQ ID NO: 81078 - DNA, 601 bp, Human
ttagtgctagacactttacattttaatctacacagtgtcccaaattcatttcacaggtgaggaaaccaatggggcacagataagcttgcctgaagtcacagctatgaagaacagagccagaattcacactcagcctggctccagagaccatgttcctaaccactagactagactaatcagcctgctccaggggctcggcctctgccctcagtggcagcactctatttgaggtctgcagccatctgcaggggatttgattttcctccccctttagggaaagcaagtctggggtcactgtggytcctttgccctctcctaagtttgcatggcagccagttttcattttgtgtcgttttattttccataggccacatttatcatatttaataaccaaatgttatttggttattggttattttgtaaaattcttcacatgaataacattagaaaaatagtctttgttagcgtccatgtcctggtttggtatttggacaaattgtggaggtgtggccagagagtatattctggagttggacaaatctatccaaatctagactctactattgactggcaacatgtctttcttttttttaattccttc

SEQ ID NO: 81079 - DNA, 601 bp, Human
cctttagggaaagcaagtctggggtcactgtggctcctttgccctctcctaagtttgcatggcagccagttttcattttgtgtcgttttattttccataggccacatttatcatatttaataaccaaatgttatttggttattggttattttgtaaaattcttcacatgaataacattagaaaaatagtctttgttagcgtccatgtcctggtttggtatttggacaaattgtggaggtgtggccagagagtatattctggagttggacaaatctatccaaatctagactctactattgaytggcaacatgtctttcttttttttaattccttcgtttcatggttttcaatgtattcaagtaatgcctgtacaagcttgatatagcacgttaaataatgcacgcgaaatacctgtacaagtgaaataatacaagatgcatgaaggtgaagctcctcgtctcctccttcagtcctgtccctctcaatcagcattagccacgttctccagggcagcctgctgagcctccacatggttgttttcctgcctataacaggaggcgaacgccctgtgatgtatgtaatgggtgctctttcagtggta

SEQ ID NO: 81080 - DNA, 601 bp, Human
cctttaatcccagcactttgggaggccaaggcgggcagatcacctgaggtcagaagttcgagaccagcctggccaacatagtgaaaccccgtctctaactaaaaatacaaaaattaggccaggcacagtggctcacgcctgtaattccagcactatgggaggctgaggtgggtggatcacgaggtcaggagttcaaaactagcctggccaagatggtgaaaccccatctctactaaaactacaaaaatcagccaagtgtggtggcaggtgcctgtaatcccagctactcggaggctgaggyaggagattggtttgaacctgggagttggaggttgcagtgagccgagatggtgccactgccctccagcctgggcaacagtgagactctgtctcaaaaaaaaatgtgtatatataaatacttaaaaaatatttgtaattgctggtttggggttactagaatctcttctgaatctgtctcagtttttcttacagcttttaaaatccatggaactctatcaccaggagatgattgtggtatggagctgatcaccccggagttagtggggtggcaactgagatcggggggaaatggagcagtttg

SEQ ID NO: 81081 - DNA, 601 bp, Human
aaggatgtgcctctaatttgtttaatcatcctctgttgttggaagttgggctattttcactactattgttattagaaacaatggcataattaacatcttggtgcatgtaactttttccgttttttggagtatttccttaagtagatttccagaggtaaaataaataactgaaaggttgaaacatttttatggcccttgcagaatattcctgggctgctttcccaaaaggtcatgtgtcttggggatgcctcccagcagtgggttggcatgtatcacaccttactctcctcctcaccaacastaggattcactattgaaatttttttttttttttttttttttttttttgcggcggagcttggtggctcacgcctgtaatcccagcattttgggagggcgaggcaggcggatcacttgaggtcaggggttcgagaccagctgaggcaagtagtgaaaccccatctctactaaaaatacaaaaattagccaggcatggtggcgtgcatcttctagtccaggctactcaggaggttgaggcaggagaattgcttgacccctggaggcggaggttgcagtgagctgggattgtgcagctgcactc

SEQ ID NO: 81082 - DNA, 601 bp, Human
ttctatttctttgtctttacaatgactgtgcttccagcctttatttttggtctggtcttcaagcttaggaacacatcgtaccacaggactcgggggacgagccaccccaaagtgagtgccactgataccgaatcctgtgaacttgctcttgaaacatgggtagctgagtccacgggtgtcaggggctggctttgcaactattaatatgagttatttgaattaacttccatagagaatgtaatgtttatgaaaaggtaattagtctgtgtgaatttgaagcttacatatattattaaaagtsaagaataatgcagcaattgttcagaattagacaaaaggttgttgggggaggtgttggattatgtttaaatcagaatcgccagctcatggtcatggtaaaaagcccatcagtttcagtattgttttaaattccttacagacaattttccctctttttgcctccctctggggcaaactgctccgtgccaggcccttagtgctgagctgagccaagctgttggctgtgctgttggctgtgctgttggctgtgctgttggtgcttttttgcttctaggcttttgcttatgcttttctcaatcct

SEQ ID NO: 81083 - DNA, 601 bp, Human
gaccttggaggggctgagcctgcaagaggccgtggtcattgtgagagtctggagtccttctccctgggacagagtccccaaggctctcccctcgtcccaccacgatacgtgtactgcccggcacacagcagatggacattgcaaaggaggtttgctctctttggagatggtcaggggctctcgttcagctcctgcctcctgagcctagaggccccaagcttagtgagacctaaatcctgactgcacaaagcagaccattcctccaagtgcctctctcatgcctgtgttcaggctcactgaytggaaggactcccagaagtcatttaagcccgttcttcagcctctatcattccagaatacatttttcagataacctgcttgcattccctcaataatgtttcatttcctctaactcagtaggaaggagatgaaacaagtctaagagaaccaggagccttctgtaagctgtgcaggcaagagagtgacttttgtgggggccaagctttaagatctcttagatagaaaactggaccagcctctacggatgtcgatgctctgtttcttggttttgcttctctgtaaatctgagggagaagacagg

SEQ ID NO: 81084 - DNA, 601 bp, Human
ggacccggcagccctcgcagcctgattgggtgtggaggggacagagcgctcacctggagctagtttagctagctagttcactgagctggttcgtgtagcccctgcagggggtcccggtctgcaggggctggtaaggacccatcatcctcgttctcctgccccaggcccagcagttgcttctgaaggagggacttcaccaacccgacagcgctcagtaatccctaccctacgctcatgggttccataaagggcgggggagaagaacctcgtgcctggtgagcagcgctgtggaggatgttckgtgccatccagcctgcgggaacatcacacggcgggtggagacgggggatgaaataaagccttactcgggtcttttctgaaagtgcttttgcatttggcatttagggggattttcttgtttgttaaagggggaaaggcagttagtcttacatccagacttttatttttagctggagctacctgtcctgccaagtccttgggcttaatttttccgatccttggtgtcttggttttgaaagcccttcccctccttccctcccagctcctttttggcaggggcaggtttcgcttttggccccag

SEQ ID NO: 81085 - DNA, 601 bp, Human
ttccaaacatggaaaactcaatgactctcactcagacttttgcaagagcaaaacaaaggctttgacacagaacaaattctcccctggcaggggcgttcttcatccactttcgacgctttgttagatgtgccttccccgagcgtgtgtcagtaaggacgttctgggaacagacttggagggaggggagagtaggcctttgttcaggcctcccccatctgaaaggtcactcttctgacaaagcccttgctgtttatgtgaggctattttataaataggggggaagcagatagccccaggtccragagagatgatgggagcccagtaatcctgttggctgagacaaaatccttggaattaagtggcacaaacctggaagctgtgtgaccttttgcaagttactaaacccctctcaacatgtttcatcatttgcaaaatggagacaacaatatcagtgttgtgagagttacctgagctattagcttattagtatctaacactatgttagacatgtaacgtgatctctttgcacacacgcagcagagttcggctggcaataccgttttcggagtgttagagggtccagggatcatttcccatttct

SEQ ID NO: 81086 - DNA, 601 bp, Human
acctgagctattagcttattagtatctaacactatgttagacatgtaacgtgatctctttgcacacacgcagcagagttcggctggcaataccgttttcggagtgttagagggtccagggatcatttcccatttctgatattttagagatttcccctcatctcttttacccaacaacaacaacaaagggagactctttctttacgattatctaaagataaaagccaagtgatcaaactatttaaataaaaagagaagtgctggaggaaaaagtagcaaattgagggaacaagtcaggtgaraaagaggctaagaagagaatgtaaaccccctctagaaaatgaaatttgccaagcaatcttattattcaccttgaaaatatctttctttggcagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaa

SEQ ID NO: 81087 - DNA, 601 bp, Human
cagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttgraggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacaccgaggtttgcccatgctgcagctggaaggctgcagaacaaaggttcgttccaacctctacacttgaattgcattctgcgtcatcatcctgccttctagaacaacatccaact

SEQ ID NO: 81088 - DNA, 601 bp, Human
tggtgggtgcagcctccgtaagctccctccttctccacagtgagctgccttctagggtcctgggacccttcctccatgcatgctcatttgcctcctcctgtatacataaaatataaactggcacgctgcagctgggagagtagccctctctagtcttcctcggaggggccattgctgttgggatgagggaaggtcactttccagggccctagagtgtccatccatccaaggagcctggtataccagctgtctgtccctcaccggacacaggaaactgaggccccaggagggactgtgaaamagtgcaatgtgtgttctcccctgatagggacatggcatgggttagggcgagccctggattgagacactctgggctcccctcctcccacaccacccctgaagcctgtcagcccctgtcctctctgagctctgctgcagggatgtgacccacgggtggtgaccggctgtgcactctccccctggacccaccgtaatggcttccccctgagcaggggcgtccccacgagccactgctgggctcatcttgtgtaatgaggtttttccattgttgccctcatgcattgtgtgccctgattgttta

SEQ ID NO: 81089 - DNA, 601 bp, Human
tcctccatgcatgctcatttgcctcctcctgtatacataaaatataaactggcacgctgcagctgggagagtagccctctctagtcttcctcggaggggccattgctgttgggatgagggaaggtcactttccagggccctagagtgtccatccatccaaggagcctggtataccagctgtctgtccctcaccggacacaggaaactgaggccccaggagggactgtgaaacagtgcaatgtgtgttctcccctgatagggacatggcatgggttagggcgagccctggattgagacactmtgggctcccctcctcccacaccacccctgaagcctgtcagcccctgtcctctctgagctctgctgcagggatgtgacccacgggtggtgaccggctgtgcactctccccctggacccaccgtaatggcttccccctgagcaggggcgtccccacgagccactgctgggctcatcttgtgtaatgaggtttttccattgttgccctcatgcattgtgtgccctgattgtttatgcagccttctgggtgcttagataagaaatgcctccgctggctctagccttctttggcgatctccatca

SEQ ID NO: 81090 - DNA, 601 bp, Human
ttaattttatttattttcaagtagttgtataaatgaatgtttaaatcccagcttcgtcatttacctctctgaggctcaggctccaccagatggaaatagaaaagaattgacttgcatgctcattgagaaaataaaataagatgctcaatataccttagttctcctttctgcccaaagggcctgctctccccaaacacacatgcacgcacacacatgcacacgcacacactcatgcacacatatgtgcatatcacacacgcatgcacacacatgcacacatcacacacatgcacatatcacrcatgcacacactgatgcacacatatgcacatacatgcacatatcacacatgcacacacacgcacacatacgcacacactcatgcacatatcacacatgcacacacactcatgcacacatgcacacaatcacatgcacacatgcacatatatcacatatgcacacatacgcacacactcatgcacacatatgcacacacacatgcacacacacgcacacacacatgcacactcccagtcctggctgttttcactgaagaaacatcctgagagggcggagcgcggtgcagaggagagagctg

SEQ ID NO: 81091 - DNA, 601 bp, Human
cccaaacacacatgcacgcacacacatgcacacgcacacactcatgcacacatatgtgcatatcacacacgcatgcacacacatgcacacatcacacacatgcacatatcacgcatgcacacactgatgcacacatatgcacatacatgcacatatcacacatgcacacacacgcacacatacgcacacactcatgcacatatcacacatgcacacacactcatgcacacatgcacacaatcacatgcacacatgcacatatatcacatatgcacacatacgcacacactcatgcacacayatgcacacacacatgcacacacacgcacacacacatgcacactcccagtcctggctgttttcactgaagaaacatcctgagagggcggagcgcggtgcagaggagagagctgtgggcttgctccctcctgtgtgacctgaagccatcggtgcaggttctgttctgaggaatttctttaaagtctctcttcaaaccactcgcaggcaagaggtgcctctggtgcctccgcatctacgaattgaatatgaactaatgtggtgcggctgggtggttgtgtcctctccagccttccttggaggg

SEQ ID NO: 81092 - DNA, 601 bp, Human
caaacacacatgcacgcacacacatgcacacgcacacactcatgcacacatatgtgcatatcacacacgcatgcacacacatgcacacatcacacacatgcacatatcacgcatgcacacactgatgcacacatatgcacatacatgcacatatcacacatgcacacacacgcacacatacgcacacactcatgcacatatcacacatgcacacacactcatgcacacatgcacacaatcacatgcacacatgcacatatatcacatatgcacacatacgcacacactcatgcacacataygcacacacacatgcacacacacgcacacacacatgcacactcccagtcctggctgttttcactgaagaaacatcctgagagggcggagcgcggtgcagaggagagagctgtgggcttgctccctcctgtgtgacctgaagccatcggtgcaggttctgttctgaggaatttctttaaagtctctcttcaaaccactcgcaggcaagaggtgcctctggtgcctccgcatctacgaattgaatatgaactaatgtggtgcggctgggtggttgtgtcctctccagccttccttggaggggt

SEQ ID NO: 81093 - DNA, 601 bp, Human
tcctgtgtgacctgaagccatcggtgcaggttctgttctgaggaatttctttaaagtctctcttcaaaccactcgcaggcaagaggtgcctctggtgcctccgcatctacgaattgaatatgaactaatgtggtgcggctgggtggttgtgtcctctccagccttccttggaggggtcgttgctcttgggacaggggagttcccctgagcattttgctcaggctgtttgttaaatggggtaaagccacctcccaccatgtgccgcataggtgatggtggtggcaaggtcctcagagcccgycaagggcccttcccatcttgtggccacaggcaatgagggcctttgctttgaatttgtcctaaccagaaattagtggttgtctttctaatgtagagctttttgtttgtttgtttctagagcaaatcatggaggaagataaaaaacatggtgcactggtctcccttcgtcatgtccttcaagaagaagtacccctggatccagctggcaggacacgcaggtagacacagctctcccagactttcccagcatggtgctcagccctctggggaggtgccctggacgctgcattctggggatcaa

SEQ ID NO: 81094 - DNA, 601 bp, Human; identical to SEQ ID NO: 24535

SEQ ID NO: 81095 - DNA, 601 bp, Human; identical to SEQ ID NO: 24536

SEQ ID NO: 81096 - DNA, 601 bp, Human; identical to SEQ ID NO: 24537

SEQ ID NO: 81097 - DNA, 601 bp, Human; identical to SEQ ID NO: 24538

SEQ ID NO: 81098 - DNA, 601 bp, Human; identical to SEQ ID NO: 24539

SEQ ID NO: 81099 - DNA, 601 bp, Human; identical to SEQ ID NO: 24540

SEQ ID NO: 81100 - DNA, 601 bp, Human; identical to SEQ ID NO: 24541

SEQ ID NO: 81101 - DNA, 601 bp, Human; identical to SEQ ID NO: 24542

SEQ ID NO: 81102 - DNA, 601 bp, Human; identical to SEQ ID NO: 24543

SEQ ID NO: 81103 - DNA, 601 bp, Human; identical to SEQ ID NO: 24544

SEQ ID NO: 81104 - DNA, 601 bp, Human; identical to SEQ ID NO: 24545

SEQ ID NO: 81105 - DNA, 601 bp, Human; identical to SEQ ID NO: 24546

SEQ ID NO: 81106 - DNA, 601 bp, Human
taataatagcagctcctgtttcctgtgtgtttactatgtgccagacgctatgctaggccccttacatgtaggagccaatttaatcctcaaaacaaccttaagaggtagggtctattgccaggcatggtggctcacgcctgtaatcccagcactttgggaggccgaggtgggtggatcacttgagatcaggagtttgagaccagtctggccaacaagatgaaaccccgtttctactaaaaatacaaaaattagccaggcgtggtggcgggcacctgtaatcccaactactcagaaggctgargcaggagaattgcttgaacccaggaggaggttgcagtgagccgagatcgcgccatcaaactccagcctgggcaacaagagtgaaactccgtctcaaaaaaaaaaaaaaaagaaaaagaaagaaaaagaggtagggtcttttcatagccccattttacagatgaggacatcgaggttccgtgcgacttagtatcttgcctgacatcacatggcaggttagtggaagaggcagaatttgagtccacgtctgtctcgcggaacagcacgtgttcttgaccgctccacacagcttcccagctat

SEQ ID NO: 81107 - DNA, 601 bp, Human
ccttaagaggtagggtctattgccaggcatggtggctcacgcctgtaatcccagcactttgggaggccgaggtgggtggatcacttgagatcaggagtttgagaccagtctggccaacaagatgaaaccccgtttctactaaaaatacaaaaattagccaggcgtggtggcgggcacctgtaatcccaactactcagaaggctgaggcaggagaattgcttgaacccaggaggaggttgcagtgagccgagatcgcgccatcaaactccagcctgggcaacaagagtgaaactccgtctcaaaaaaaaaaaaaaaagaaaaagaaagaaaaagaggtagggtcttttcatagccccattttacagatgaggacatcgaggttccgtgcgacttagtatcttgcctgacatcacatggcaggttagtggaagaggcagaatttgagtccacgtctgtctcgcggaacagcacgtgttcttgaccgctccacacagcttcccagctataacagtggatttactgctctctcacacacacaccatgatgcaggggcctaaaaacagacagaagaacacaggtgtaccgggcactcgcacacatg

SEQ ID NO: 81108 - DNA, 601 bp, Human
agtattcattgtgcatctattatgtgccaggaaccagcagtgaagacaaagtctgtgctctcgggaagcttatatttttgtggaagacagagcggcagacaattaaacaaatatatagcatctcaggtgatttaaaataatactaataataaggtattggccaggagcagtggctcacgcctgtaatcatagcactctgggaggccgacgcaggcggatcacctgaggtcaggagttcgagaccagcctggtcaacatagtgaaaccccgtctctaccgaaaatacaaaaattagccaggygtggtggcgggcacctgtaatcccagctactcgggaggctgaggtaggagaatcacttgaacacgggaggcagaggttgcaatgagccgagatggcgccactgcactctagcctgggcaacagagtgagactctgtctcaaaaaaataaaaaataaaaataaggtcagaagaggacaaacagaatgaggggttcagttttaaaagggatggccaggggaagagctgaaagggggatatttggcaaatatttgggacatttcggagagctaaaagggggttatttgggcaaaggcctgaag

SEQ ID NO: 81109 - DNA, 601 bp, Human
agacaattaaacaaatatatagcatctcaggtgatttaaaataatactaataataaggtattggccaggagcagtggctcacgcctgtaatcatagcactctgggaggccgacgcaggcggatcacctgaggtcaggagttcgagaccagcctggtcaacatagtgaaaccccgtctctaccgaaaatacaaaaattagccaggcgtggtggcgggcacctgtaatcccagctactcgggaggctgaggtaggagaatcacttgaacacgggaggcagaggttgcaatgagccgagatggygccactgcactctagcctgggcaacagagtgagactctgtctcaaaaaaataaaaaataaaaataaggtcagaagaggacaaacagaatgaggggttcagttttaaaagggatggccaggggaagagctgaaagggggatatttggcaaatatttgggacatttcggagagctaaaagggggttatttgggcaaaggcctgaaggaagtgagggaggaaatcatggatctaggagaagggtgttccaggcggagggaacagccatgcaaagccttggaggagagacctgtcagtatggtt

SEQ ID NO: 81110 - DNA, 601 bp, Human
aattaaacaaatatatagcatctcaggtgatttaaaataatactaataataaggtattggccaggagcagtggctcacgcctgtaatcatagcactctgggaggccgacgcaggcggatcacctgaggtcaggagttcgagaccagcctggtcaacatagtgaaaccccgtctctaccgaaaatacaaaaattagccaggcgtggtggcgggcacctgtaatcccagctactcgggaggctgaggtaggagaatcacttgaacacgggaggcagaggttgcaatgagccgagatggcgccrctgcactctagcctgggcaacagagtgagactctgtctcaaaaaaataaaaaataaaaataaggtcagaagaggacaaacagaatgaggggttcagttttaaaagggatggccaggggaagagctgaaagggggatatttggcaaatatttgggacatttcggagagctaaaagggggttatttgggcaaaggcctgaaggaagtgagggaggaaatcatggatctaggagaagggtgttccaggcggagggaacagccatgcaaagccttggaggagagacctgtcagtatggttgaga

SEQ ID NO: 81111 - DNA, 601 bp, Human
agggaacagccatgcaaagccttggaggagagacctgtcagtatggttgagaaataacgcggaagccggtgtggcaggggcagcgtgtgctagaggagagtgggaggtgagctagagaggaaataagtgcaggtcagtgtcaggaccttggctttgaccctgagtaagatggagctattggaagggtttctgagcaaaggagagttgtgggctgacatatttttatatattccataaaatatttttaatatattttataaaaaatatatattgcaacatatttcattttatatatttcatrtacactttttttttttttggtagagacagagtctcatttagtggtaccatcatggttcactgtagccttgacctcctgagctcaagcaatcctcccaccttagcctcccgagtagctgggtctataagcacacgccaccacgcattcccagctaatttttcttcttgttttttgtttgtttgtttgttttttaacttagaagcccaaacctcaccataagttttctattttttgtagagatggggatttgccatgtggctcaggctggtctcaaactcctggcctcaagcaatccccccg

SEQ ID NO: 81112 - DNA, 601 bp, Human
gaaataagtgcaggtcagtgtcaggaccttggctttgaccctgagtaagatggagctattggaagggtttctgagcaaaggagagttgtgggctgacatatttttatatattccataaaatatttttaatatattttataaaaaatatatattgcaacatatttcattttatatatttcatatacactttttttttttttggtagagacagagtctcatttagtggtaccatcatggttcactgtagccttgacctcctgagctcaagcaatcctcccaccttagcctcccgagtagctgrgtctataagcacacgccaccacgcattcccagctaatttttcttcttgttttttgtttgtttgtttgttttttaacttagaagcccaaacctcaccataagttttctattttttgtagagatggggatttgccatgtggctcaggctggtctcaaactcctggcctcaagcaatccccccgtctcggcttcccaacgtgctgggattacaggcatgagccaacgcacctggccggagatatttttaaacccacactgctgggttcagaatagacaggagtaggccagcgtacaagtgaga

SEQ ID NO: 81113 - DNA, 601 bp, Human
atacactttttttttttttggtagagacagagtctcatttagtggtaccatcatggttcactgtagccttgacctcctgagctcaagcaatcctcccaccttagcctcccgagtagctgggtctataagcacacgccaccacgcattcccagctaatttttcttcttgttttttgtttgtttgtttgttttttaacttagaagcccaaacctcaccataagttttctattttttgtagagatggggatttgccatgtggctcaggctggtctcaaactcctggcctcaagcaatccccccstctcggcttcccaacgtgctgggattacaggcatgagccaacgcacctggccggagatatttttaaacccacactgctgggttcagaatagacaggagtaggccagcgtacaagtgagagatagttagatggatgccgcaactgtgcaggcaagggcggtggaagcttggatgagtttattctcacagccgccctgggagtaagttccagcattgcctcccccttacagatgagggaactgaggcacaaggctacacagccaggagcagcaaagtcacaacatgaacccaagtcccttga

SEQ ID NO: 81114 - DNA, 601 bp, Human
tcttcccccaaaatgagtcccactaaagccccgagctccctctctatcccactggctggcaggaccagggggccaccctgacctggaccccttcctctgcccagcaacacccggacctaccgtgtggccgtgggaaagaacaacctggaggtggaagacgaagaaggatccctgtttgtgggtgtggacaccatccacgtccacaagagatggaatgccctcctgttgcggtgagtgacagactgcccatcccacagccactgggggcagtgtggaaggaggggtccccaagacggagccrcagagcctgtcgcaccccatacctgacaccccatcctcaccctggaaagccagcaaatgactgtcttacacaaaatggcaaaatgctaagtggagacaaataccccctcatatccccctcattggccaagactcccaggaaagtccacaaggaaggccccccacagtgtctctccagaggctgggccagcgctcacctttattgagttcctactgtatgcccacattgcaatagacactttatatgccatctgttatgtaatcctcacaacagccctggacaaagaaccaaggctcagag

SEQ ID NO: 81115 - DNA, 601 bp, Human
aggacccctgagcaccctgggcctgactcccaactcacagcccgagccccttagcctgagcttgtggggccagggccctcctgcccactcaccctctccactttggattccagcaatgatattgccctcatcaagcttgcagagcatgtggagctgagtgacaccatccaggtggcctgcctgccagagaaggactccctgctccccaaggactacccctgctatgtcaccggctggggccgcctctggagtgagtatcgtccctggcaaatcctgagagccttcctgaaggaagcaggamgtcacccacatttgtccaccactttgcctttttgccttcacattttcatgtctttgtaaactttgtaacaataacagctaatatttactaagcacataccatgtgacagacactctagcaagggtctctgagagatgtggtaaagtttagacgaattagaatttgtcaagtgctcagaacagcacttggcacatagtaagtgtcacataaataaactaaaataaaccattaggggtaggggatgacatctgtggtataccgtatgcccaaataggtcccagctgaattaaaagttaaatg

SEQ ID NO: 81116 - DNA, 601 bp, Human
tcccaggcatctgctccctgaaggcctggggaggggctggactgggcttcccggctgcctccctggtcactgctcactctctccccagccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatgtgagtggctaggttctgcaccttgtccctactccaagtggccaagtggatgtgggcaaaggggggkgcgatggaccaaacccttctcctgggaggagactgagcgagccctggctgggcccagcaggctcagggtaagcccatcaccccccatcactgtggtgagagcatgagcattgagcacgagtatctgagttcaagccccagtcccaccatttatgagctacgtaaacttgggagggccgttgaacctctgacctcagtttttccatctgtaaaatggagttacagtaaccacttcacagggttaggactaaatgagtttaaaggacagagaagaggcttcactgaagtctctacacatgtt

SEQ ID NO: 81117 - DNA, 601 bp, Human
gcctgcatcctcactgctctgagtagctcacagagtcttagataaggagacctgaacagctagggaaactgaggcacggagaggattaacatcatcccaagatcacacagcaaaccaagagctagtctgacaccccagggcctcccagaataaggccaaggcagccgcaaaccacatttcctctgcctccctcaccatgggcaggctgaggccaaatctgtccactaactaaggctgagaagccaacccacatcccccaccccaacccagtcctgcttcccaagacttcctctgggggggkgcctggtggcttatgccctcccggtctggtgcagggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgaggtgggtgctgcctccacagctgtccctgcacctgtcagcccctccccctcactcacccatcccctcactcattcactcattcatgcgtttattcattcattcatttattcact

SEQ ID NO: 81118 - DNA, 601 bp, Human
aaaaaaaagagtgtaaaattctcagctttggggacaagatccattattatgcccaagaatcaatgcctatgtatggtaaacagaataatgctccctgcaaaagatgtgtacaccccaatccccagaacctgtgaacatgttaccttactcagcaaaagagattgttcagatatgattaaattaaggatcttcccatggagtgaccatcttggattatctgggtggggtctgtgtaatcaataagggtccttagaacagtgagacaagaaggtcagggtcagagagagatttaaggatgctrcactgctggctctgaagatagaggaaggggccatgaaccaaggaatgcaggcggcctctggaagctggtaaaggccaggaaatggattcttctctacacctccagaagggaacagtcctgcctatacctggactttagcccagtgaggaaaaactgtggacttctgacctccagaactacaagataataaatgtgtgtgttttttgccactaagtttgtgacaatttattacaacagcaataggaaccagattcaccatccttcctcccgtgttagaaggcaaaatccaaagcgcactgt

SEQ ID NO: 81119 - DNA, 601 bp, Human
tgagtagctgggactacaggcatgcagccccacacgctactaatttttgtatttttagtagagacggggtttcaccatgttggccaggctggtcttgaactcctggcctcaggtggtctgcccgcatcagcctcccaaagttctgggattataggagtgagccaccgtgcccggccgtaaagtgcattttcatccaccagatgaagccctcctctgccagcgttctgcttccccccatcattagagtggccagatcctaattgtgcatgtcggccttgccttctgctacatgtgcaccttycccgcattatgcaaattctgctacatgtgcaccttccccacattatacaaatccttaccacaatgttgtgaaacaatactgggcatgggtttctctccctgtttcacagatgggtctagagacttacatgactcagccaaggtcacattgcaacccctggtatggcctagaacaggctttctcagtctcagcaccattgacatttggggcagggcgagtcctattgcccagtgcattgtcgggtgtttagcagcgtctctgctctcgctccctgcccactggatgccaatttacatcaac

SEQ ID NO: 81120 - DNA, 601 bp, Human
ccagcgttctgcttccccccatcattagagtggccagatcctaattgtgcatgtcggccttgccttctgctacatgtgcacctttcccgcattatgcaaattctgctacatgtgcaccttccccacattatacaaatccttaccacaatgttgtgaaacaatactgggcatgggtttctctccctgtttcacagatgggtctagagacttacatgactcagccaaggtcacattgcaacccctggtatggcctagaacaggctttctcagtctcagcaccattgacatttggggcagggcragtcctattgcccagtgcattgtcgggtgtttagcagcgtctctgctctcgctccctgcccactggatgccaatttacatcaaccccagccatgacaaccaaaattctctccagatgttgtcaaacgtctcctggtgggctgaaccagccccattgagaaatactgccttagaatgctgtgggctcagcatgccaccttaatcttttcattgaaaacacaactcctggccgggcatggtggctcagcctgtaatcctagcactttgggaggccgaggcgagcagatcacttgaggccagg

SEQ ID NO: 81121 - DNA, 601 bp, Human
ttctctccctgtttcacagatgggtctagagacttacatgactcagccaaggtcacattgcaacccctggtatggcctagaacaggctttctcagtctcagcaccattgacatttggggcagggcgagtcctattgcccagtgcattgtcgggtgtttagcagcgtctctgctctcgctccctgcccactggatgccaatttacatcaaccccagccatgacaaccaaaattctctccagatgttgtcaaacgtctcctggtgggctgaaccagccccattgagaaatactgccttagaaygctgtgggctcagcatgccaccttaatcttttcattgaaaacacaactcctggccgggcatggtggctcagcctgtaatcctagcactttgggaggccgaggcgagcagatcacttgaggccaggagttcgacaccagcctggccaacatgatgagaccccccgtctctactaaaaatacaaaaattagccagcaatggtggcacacacctgtaatcccaactactagggaggctgaagcaggggaattgcttgaacccaggaggcagaggttgcagtgagctgagatcacgccacttca

SEQ ID NO: 81122 - DNA, 601 bp, Human
aaggacgctgctgctgtccactttggtggctggaggtaagtcctgttacccagaggcactggtttcccatgccctggtggggctggaaatgggatcttcctgtcctcccctctcgcccccacccaacccctactgcattcagacctataatcataagaacattggaatggagtttcaaagaattggagcaaagagcaggattctatgacctcttgggatccttctagaacaagggttttctatttggggggtcagaatgcgcagcaagtgtagtttacattgtgtgggtcgctgcttcctgactcaagaccctttctcttttcacagccctcagttgtggggaccccacttacccaccttatgtgactagggtggttggcggtgaagaagcgaggcccaacagctggccctggcaggtgagttgaccacactgtacttctccccgtccctgccccactccctttacatctcccctttgcccttccaccatggcgtctattgtgctggcaaagtgagtattgatgggactcagagagcagcacaggcaactttagcaataagatatatttccggctgggcgcagtggctcatgcctgttatc

SEQ ID NO: 81123 - DNA, 601 bp, Human
catctcccctttgcccttccaccatggcgtctattgtgctggcaaagtgagtattgatgggactcagagagcagcacaggcaactttagcaataagatatatttccggctgggcgcagtggctcatgcctgttatcccagcactgtgggaggctgtggtgggcagatcacctgaagtcaggagtttgagaccagcctggccaacatggtgaaacctgcctctactaataatacacaagtagccaggtgtggtggcacacgcctgtaatcccagcaactggggaggcttaggcaggaggatygcttgaacccaggaggcagaggttgcagtgagctgaaattgcaccactgtactccagcctgggcaacaaagcaagactctgtctcaaaaaaaaaaaaaaagatacatttctgtggccttggccaaccttgggagtggagggagaggtgcctcctccagctgcagtaaggagctgtcccctccccactgcccataggcagcaaatatagtattactctattaaccaatcagaggcttgtttacaaatgtaccatcagtctaggaaccattcaagactacctatgcaaacattccttgcttt

SEQ ID NO: 81124 - DNA, 601 bp, Human
ggccaacatggtgaaacctgcctctactaataatacacaagtagccaggtgtggtggcacacgcctgtaatcccagcaactggggaggcttaggcaggaggatcgcttgaacccaggaggcagaggttgcagtgagctgaaattgcaccactgtactccagcctgggcaacaaagcaagactctgtctcaaaaaaaaaaaaaaagatacatttctgtggccttggccaaccttgggagtggagggagaggtgcctcctccagctgcagtaaggagctgtcccctccccactgcccataggyagcaaatatagtattactctattaaccaatcagaggcttgtttacaaatgtaccatcagtctaggaaccattcaagactacctatgcaaacattccttgctttaaggaaccaatcagtgctatttgcgcagattaatctttaaccacaggcaaatcaatgttaccaatgaaaaaaatgttttcttaagttgatataatcatagtggtatcaagactaaactgccaagtggggcacaggtgtaaattactcagacgtgttaatggtggggattttaagagaaatgtgtaaagtttacattg

SEQ ID NO: 81125 - DNA, 601 bp, Human
attttctcacagacactacttcaagagcaattttttaagagtcatggtgatccagtctcttccaagcatttaactttgtttccatataaataacgactctctttctgaactcatatttcattggttacatgtttaatcaaatttcattattacaagcataattgatataaactgctttgggagcaaacccagctgaatcaggatgagtttctaccttaagtaggaggagcaactagcagcccactagccttgagcattcagagtgacccatgcagcagtcactgtgtttagagaggccagsgttcattcatctgctccttgattaagagactgtcaatgataggccaggcgtggtggctcatgcctgtaatcccagcactttggcaggccgaggcaggtggatcacctgaggtcaggagtttgagaccagcctggccaacatggtgaaactctgcctctactaaaaatacaaaaattagccaggcatggtggcgggcacctgtagtcccagctacttgggaggctgaggcacaagaatcgcttgaacctgggaggcgcaggttgcggtgagccaagatcacacctctgcactccagcctgg

SEQ ID NO: 81126 - DNA, 601 bp, Human
gtgatcctcctgcgtcggcctcccaaagtgctgggatcacaggcgtgagcctctcaacccagcctcacaatttatatacttggctttgtgtgcttttgccagttcttttgcttttctcacagtcccacagtattttttccctgagaatttggaagaagggccacagtccctctgctacagggccccataacaccgggcgcatttgtgctaagaactaatcattgctgcctacaaaaatacttcctcaccctcttgcacaaaagtattcttgccttgagaaccagtgaatgttaatccatgragagtccctatgctttgtgcttctgtttccctgcggaaataaggcagatctagctgggtggggactcagatgaggcaagtaagacattcactctggaggcaaaatgtaagggggtagcacaaaactcagcaaccagccaggaacagtggcacacacctttaatcccagctattcaaggggctgaggcaggaggatttcttgagcccaagagtttgagaccagcatgggcaacatagatagccatctcaaaaaaaaaaaaaaaatacaaacaaacaaaaaacctcactaacgaagatgaat

SEQ ID NO: 81127 - DNA, 601 bp, Human
cgcatttgtgctaagaactaatcattgctgcctacaaaaatacttcctcaccctcttgcacaaaagtattcttgccttgagaaccagtgaatgttaatccatgaagagtccctatgctttgtgcttctgtttccctgcggaaataaggcagatctagctgggtggggactcagatgaggcaagtaagacattcactctggaggcaaaatgtaagggggtagcacaaaactcagcaaccagccaggaacagtggcacacacctttaatcccagctattcaaggggctgaggcaggaggattkcttgagcccaagagtttgagaccagcatgggcaacatagatagccatctcaaaaaaaaaaaaaaaatacaaacaaacaaaaaacctcactaacgaagatgaatgatattttaatgcaattttgtttcttctccaggagacagagtctcattctgtcacccaggcttaattacagtatgagtcaccctgagagccctgcacagtggcttatgttccccatttccagagaaggcaactgggacttggaaaggttacagaattccccaaaggcactgggttagcccggggggcgaatgaggat

SEQ ID NO: 81128 - DNA, 601 bp, Human
atgcaattttgtttcttctccaggagacagagtctcattctgtcacccaggcttaattacagtatgagtcaccctgagagccctgcacagtggcttatgttccccatttccagagaaggcaactgggacttggaaaggttacagaattccccaaaggcactgggttagcccggggggcgaatgaggattcaaatctggttcagtgctacctctttagctacactttgctggccacacataatacgtattatgtgggctaaatttcacatctgtacgatggtttcagcacatttttaaattggggggggtacatccttttaagtatcttttttcactttttctaattttaaacatcttttttaagacctcttaatgtcacacaaacgagaaatgccaaatggctaattaaaaacaacaacgttcagagaaaagcaggcatctgccaacaaacaggtcatcgttccccacagttatagggagcccgatcagagcagtccatgccctactgtcacctccctcccctctgcttggccgtggcagggaattgaaagacaggggaggaggaatgaaggaacaggaagggcatggaacagcttcatta

SEQ ID NO: 81129 - DNA, 601 bp, Human
ctaattttaaacatcttttttaagacctcttaatgtcacacaaacgagaaatgccaaatggctaattaaaaacaacaacgttcagagaaaagcaggcatctgccaacaaacaggtcatcgttccccacagttatagggagcccgatcagagcagtccatgccctactgtcacctccctcccctctgcttggccgtggcagggaattgaaagacaggggaggaggaatgaaggaacaggaagggcatggaacagcttcattagagactaaaacagtgtcaaatgtcaccaccttaaagttcttttttttttttttaaagacctggtctcactctgttaattttattttattttaaaatttttttggtagggtcaagttctcactatggtgcccaggctggttcacaaactcctgggttcaagcaatactcccacctcagccttctgagtaaccgggactataggcatgcaccgccgcacccagcggctcattttgggctatttttgttgtagagacaatgtattagtcctgcctcacacggctaataaagacatatctgagactgggtaatttataaaggaaagaggtttaactgactcata

SEQ ID NO: 81130 - DNA, 601 bp, Human
acaaactcctgggttcaagcaatactcccacctcagccttctgagtaaccgggactataggcatgcaccgccgcacccagcggctcattttgggctatttttgttgtagagacaatgtattagtcctgcctcacacggctaataaagacatatctgagactgggtaatttataaaggaaagaggtttaactgactcatagctcagcgtggctggggaggcctcaggaaacttataatcatggcagaagggaaaggaaacacatccttgttcacgcagcggtagcagggagaagtgccgagmaaaagtgggggaaagacccttataaaaccatcagatcttgtgagaacttactcactatcatgaaaacagcatggaggtgaccaccctcatgattcaattacctcccaccaggtccctcgcacgacaaatggggattataagaactataattcaagatgagatttgggtagggacacagccaaaccttatcagatggggtttcaccatgttgcccaggctggtctcaaactcctgggctcaagtgatcctccttccttggcctcccgaagtgttgggattacaagcatgagccaccatgcc

SEQ ID NO: 81131 - DNA, 601 bp, Human
aagacatatctgagactgggtaatttataaaggaaagaggtttaactgactcatagctcagcgtggctggggaggcctcaggaaacttataatcatggcagaagggaaaggaaacacatccttgttcacgcagcggtagcagggagaagtgccgagcaaaagtgggggaaagacccttataaaaccatcagatcttgtgagaacttactcactatcatgaaaacagcatggaggtgaccaccctcatgattcaattacctcccaccaggtccctcgcacgacaaatggggattataagaaytataattcaagatgagatttgggtagggacacagccaaaccttatcagatggggtttcaccatgttgcccaggctggtctcaaactcctgggctcaagtgatcctccttccttggcctcccgaagtgttgggattacaagcatgagccaccatgcctggcctgattgtttttcatgtagattgcattaacacgttttttatcttgatggctgaggttttgggtgctgccttaagttgtgcacatgaggcgactgcctcactcccccttacccttgtcccagccccgttcttgggaaactg

SEQ ID NO: 81132 - DNA, 601 bp, Human
tcatagctcagcgtggctggggaggcctcaggaaacttataatcatggcagaagggaaaggaaacacatccttgttcacgcagcggtagcagggagaagtgccgagcaaaagtgggggaaagacccttataaaaccatcagatcttgtgagaacttactcactatcatgaaaacagcatggaggtgaccaccctcatgattcaattacctcccaccaggtccctcgcacgacaaatggggattataagaactataattcaagatgagatttgggtagggacacagccaaaccttatcagayggggtttcaccatgttgcccaggctggtctcaaactcctgggctcaagtgatcctccttccttggcctcccgaagtgttgggattacaagcatgagccaccatgcctggcctgattgtttttcatgtagattgcattaacacgttttttatcttgatggctgaggttttgggtgctgccttaagttgtgcacatgaggcgactgcctcactcccccttacccttgtcccagccccgttcttgggaaactggagtgcagggaggccctgctctttcaaacctagccacagagctcctttgc

SEQ ID NO: 81133 - DNA, 601 bp, Human
aacacatccttgttcacgcagcggtagcagggagaagtgccgagcaaaagtgggggaaagacccttataaaaccatcagatcttgtgagaacttactcactatcatgaaaacagcatggaggtgaccaccctcatgattcaattacctcccaccaggtccctcgcacgacaaatggggattataagaactataattcaagatgagatttgggtagggacacagccaaaccttatcagatggggtttcaccatgttgcccaggctggtctcaaactcctgggctcaagtgatcctccttccytggcctcccgaagtgttgggattacaagcatgagccaccatgcctggcctgattgtttttcatgtagattgcattaacacgttttttatcttgatggctgaggttttgggtgctgccttaagttgtgcacatgaggcgactgcctcactcccccttacccttgtcccagccccgttcttgggaaactggagtgcagggaggccctgctctttcaaacctagccacagagctcctttgcttctccccaggtctccctgcagtacagctccaatggcaagtggtaccacacctgcggagggt

SEQ ID NO: 81134 - DNA, 601 bp, Human
tgtcccagccccgttcttgggaaactggagtgcagggaggccctgctctttcaaacctagccacagagctcctttgcttctccccaggtctccctgcagtacagctccaatggcaagtggtaccacacctgcggagggtccctgatagccaacagctgggtcctgacggctgcccactgcatcaggtaactgcctttccctgggcgcttggcctgctcaccagctggtgctcatttctgagctgggggctcaaatggcctgaaccatgctacataaagcagccttgcaaataaccactatmctggctgagacacaagctgtagtcaatcaatggttcagtgtgttggcccatcaatgtcagtacatggcatggatggagtgtctgtgccaggcaggcactgagggaggatgaagaggaggggaaggcccaatctctgccctcttggggaaactacatgtggcctctggatctggaattgggttcccttgaacaacttaactgacttctcaaagcttcaataccatcacctgcagaaaaatggagtaacagaatttagtgtgaattcaatgagttgatttaccaaagggcctggcacttagt

SEQ ID NO: 81135 - DNA, 601 bp, Human
gctggtgctcatttctgagctgggggctcaaatggcctgaaccatgctacataaagcagccttgcaaataaccactatactggctgagacacaagctgtagtcaatcaatggttcagtgtgttggcccatcaatgtcagtacatggcatggatggagtgtctgtgccaggcaggcactgagggaggatgaagaggaggggaaggcccaatctctgccctcttggggaaactacatgtggcctctggatctggaattgggttcccttgaacaacttaactgacttctcaaagcttcaatacyatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataataga

SEQ ID NO: 81136 - DNA, 601 bp, Human
tacatggcatggatggagtgtctgtgccaggcaggcactgagggaggatgaagaggaggggaaggcccaatctctgccctcttggggaaactacatgtggcctctggatctggaattgggttcccttgaacaacttaactgacttctcaaagcttcaataccatcacctgcagaaaaatggagtaacagaatttagtgtgaattcaatgagttgatttaccaaagggcctggcacttagtaagtgctcagtgaaagctaattctgaattatagatgaattataaaggcccacaaggttctrcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgac

SEQ ID NO: 81137 - DNA, 601 bp, Human
gcaggcactgagggaggatgaagaggaggggaaggcccaatctctgccctcttggggaaactacatgtggcctctggatctggaattgggttcccttgaacaacttaactgacttctcaaagcttcaataccatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccc

SEQ ID NO: 81138 - DNA, 601 bp, Human
ggcccaatctctgccctcttggggaaactacatgtggcctctggatctggaattgggttcccttgaacaacttaactgacttctcaaagcttcaataccatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcacyggagtttctgccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataa

SEQ ID NO: 81139 - DNA, 601 bp, Human
actgacttctcaaagcttcaataccatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatac

SEQ ID NO: 81140 - DNA, 601 bp, Human
accatcacctgcagaaaaatggagtaacagaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatrgaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatactttaggccctatgataactaac

SEQ ID NO: 81141 - DNA, 601 bp, Human
agaatttagtgtgaattcaatgagttgatttaccaaagggcctggcacttagtaagtgctcagtgaaagctaattctgaattatagatgaattataaaggcccacaaggttctgcaacgttgttcacttatcctcttctttgtccgtgacctctgctcatcacagctggaactcaccggagtttctgccgggtcggcgtgactccctaccaggagtgatcccttctcccatccgatttataataagctctaggaggtattggggaaaataatagaggcctacagtcaggagtcctggcttstagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatactttaggccctatgataactaactgattgtcccaggggaggaaagatcccc

SEQ ID NO: 81142 - DNA, 601 bp, Human
gccgggtcggcgtgactccctaccaggagtgatcccttctcccatccgatttataataagctctaggaggtattggggaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttyatattgtagtttatagttagtatagtaacaattattatatgatcatagttcttaggttatatactttaggccctatgataactaactgattgtcccaggggaggaaagatccccaagtcccatctagtggctcacgcagcagccagttacttgggtctatccccagcattattcaaagccaggcctctggaggtgaccctctccctgggccccctttctcccagctcctccaggacctaccgcgtggggctgggccggcacaacctctacgttgcggagtccggctcgctggccgtcagt

SEQ ID NO: 81143 - DNA, 601 bp, Human
gaaaataatagaggcctacagtcaggagtcctggcttgtagttctggtttctcactaacggtgggactctgggccaggttacgcctctctgggcctcagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatactttaggccctatkataactaactgattgtcccaggggaggaaagatccccaagtcccatctagtggctcacgcagcagccagttacttgggtctatccccagcattattcaaagccaggcctctggaggtgaccctctccctgggccccctttctcccagctcctccaggacctaccgcgtggggctgggccggcacaacctctacgttgcggagtccggctcgctggccgtcagtgtctctaagattgtggtgcacaaggactggaactccaaccaaatctccaaagggttcgtttctgtctgggtgcactt

SEQ ID NO: 81144 - DNA, 601 bp, Human
cagtttccccatctgcaaatgaaaggtgggaaaaatgtccttgagggcaaatgactcctgttttctctgtgttcatctcattccctccataagaactatagagtttgtgttattataacttttatttcatattgtagtttatagttagtatagtaacaattattatatgatcatagttcttaggttatatactttaggccctatgataactaactgattgtcccaggggaggaaagatccccaagtcccatctagtggctcacgcagcagccagttacttgggtctatccccagcattatycaaagccaggcctctggaggtgaccctctccctgggccccctttctcccagctcctccaggacctaccgcgtggggctgggccggcacaacctctacgttgcggagtccggctcgctggccgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacgcccactgcttcttctacagggagggggaag

SEQ ID NO: 81145 - DNA, 601 bp, Human
ttatttcatattgtagtttatagttagtatagtaacaattattatatgatcatagttcttaggttatatactttaggccctatgataactaactgattgtcccaggggaggaaagatccccaagtcccatctagtggctcacgcagcagccagttacttgggtctatccccagcattattcaaagccaggcctctggaggtgaccctctccctgggccccctttctcccagctcctccaggacctaccgcgtggggctgggccggcacaacctctacgttgcggagtccggctcgctggcmgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacgcccactgcttcttctacagggagggggaaggagctctggcctcttagatgtggaaccagctccaaagatgtctggggtggggatgtgacctggggaggctgaagcaaagactgccagagcgacctgggtttgctgccagttacacctgcag

SEQ ID NO: 81146 - DNA, 601 bp, Human
ccagttacttgggtctatccccagcattattcaaagccaggcctctggaggtgaccctctccctgggccccctttctcccagctcctccaggacctaccgcgtggggctgggccggcacaacctctacgttgcggagtccggctcgctggccgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacscccactgcttcttctacagggagggggaaggagctctggcctcttagatgtggaaccagctccaaagatgtctggggtggggatgtgacctggggaggctgaagcaaagactgccagagcgacctgggtttgctgccagttacacctgcagggcccctgtccgctgagcatgtatctacttcatgccaggtcctggggacacagggacagtgctgtcaaccctgtgactgtccctggagtaggacacaatctctcctgccttccccctttcaacaaggccctctgcattttcaaacatgc

SEQ ID NO: 81147 - DNA, 601 bp, Human
ttacttgggtctatccccagcattattcaaagccaggcctctggaggtgaccctctccctgggccccctttctcccagctcctccaggacctaccgcgtggggctgggccggcacaacctctacgttgcggagtccggctcgctggccgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacgcccwctgcttcttctacagggagggggaaggagctctggcctcttagatgtggaaccagctccaaagatgtctggggtggggatgtgacctggggaggctgaagcaaagactgccagagcgacctgggtttgctgccagttacacctgcagggcccctgtccgctgagcatgtatctacttcatgccaggtcctggggacacagggacagtgctgtcaaccctgtgactgtccctggagtaggacacaatctctcctgccttccccctttcaacaaggccctctgcattttcaaacatgccctg

SEQ ID NO: 81148 - DNA, 601 bp, Human
gcgtggggctgggccggcacaacctctacgttgcggagtccggctcgctggccgtcagtgtctctaagattgtggtgcacaaggactggaactccaaccaaatctccaaagggttcgtttctgtctgggtgcacttgggggtgaggttgtcagggaacagatgggggtctcacagaggcaagggtctcaaccacaccacacgcccactgcttcttctacagggagggggaaggagctctggcctcttagatgtggaaccagctccaaagatgtctggggtggggatgtgacctggggaggstgaagcaaagactgccagagcgacctgggtttgctgccagttacacctgcagggcccctgtccgctgagcatgtatctacttcatgccaggtcctggggacacagggacagtgctgtcaaccctgtgactgtccctggagtaggacacaatctctcctgccttccccctttcaacaaggccctctgcattttcaaacatgccctggggccctgccagtcagagcaacctggggtaacagggtacagggaagatgacaaggtctccaagccctccaaagcccacagggcaggaaaagtcaa

SEQ ID NO: 81149 - DNA, 601 bp, Human
aaccacaccacacgcccactgcttcttctacagggagggggaaggagctctggcctcttagatgtggaaccagctccaaagatgtctggggtggggatgtgacctggggaggctgaagcaaagactgccagagcgacctgggtttgctgccagttacacctgcagggcccctgtccgctgagcatgtatctacttcatgccaggtcctggggacacagggacagtgctgtcaaccctgtgactgtccctggagtaggacacaatctctcctgccttccccctttcaacaaggccctctgcrttttcaaacatgccctggggccctgccagtcagagcaacctggggtaacagggtacagggaagatgacaaggtctccaagccctccaaagcccacagggcaggaaaagtcaacccggtcctcatgcttcgcctccacactcacccaggaacgacattgccctgctcaaactggctaaccccgtctccctcaccgacaagatccagctggcctgcctccctcctgccggcaccattctacccaacaactacccctgctacgtcacgggctggggaaggctgcagagtaagtgggagccagg

SEQ ID NO: 81150 - DNA, 601 bp, Human
tcacgtcacccctgtctggccggggcctctcacctgtcatcccagggtgtgtggctgccttggagagacgggatggcataggctgacgcctgcctgggatcaaatgtcagctctcccacttaatgactgtgacaccttggacacattactaggtctctccatgcagcacttttttcatctgtaaaatgcaaatatttggctgggcgcagtggctcatacctgtaatcccagcactttgggaggcccatcccgcggatcacttgaggtcaggagaccagcctgaccaacacggagaaactcygtctctactaaaaatattaaaaaaaaaaaaaatagcaggatgtggcagtgtgcacctgtagtcccagctactcaggaggctgaggcacgagaatcacttgaacctgggagatggaggttgcagtgagccaagatttcgctactgcactccagcctgggggacagagcgagactccgcctcaaaaacaaaaggcataataatagcacctacatcacagagttgtcacgaggattaaaggagataatccataggaagcccagaatggggtaggtgctgtgttagttgttgtcactgtcccta

SEQ ID NO: 81151 - DNA, 601 bp, Human
accagcctgaccaacacggagaaactctgtctctactaaaaatattaaaaaaaaaaaaaatagcaggatgtggcagtgtgcacctgtagtcccagctactcaggaggctgaggcacgagaatcacttgaacctgggagatggaggttgcagtgagccaagatttcgctactgcactccagcctgggggacagagcgagactccgcctcaaaaacaaaaggcataataatagcacctacatcacagagttgtcacgaggattaaaggagataatccataggaagcccagaatggggtaggtrctgtgttagttgttgtcactgtccctatgatggagagaaagttacagagaccatgtgacatcttctgtgtggcccaaggctagagttcagaacagcattttcctctgtgacctgagacccctggagccctcatcagaccctccatgccccatagcaaaagctgtcccctgtgccattaggtcttgctgctcagaacctgaatgagggcgggtctcctttgacatagactccaagggtcagagatccaatgacagtagccaccaagaggaacagagttcccgcccttcccttgtgaaatca

SEQ ID NO: 81152 - DNA, 601 bp, Human
gagttcagaacagcattttcctctgtgacctgagacccctggagccctcatcagaccctccatgccccatagcaaaagctgtcccctgtgccattaggtcttgctgctcagaacctgaatgagggcgggtctcctttgacatagactccaagggtcagagatccaatgacagtagccaccaagaggaacagagttcccgcccttcccttgtgaaatcaccagaggtttggaagattctaggaagggatgagtaataatgaccttatgaccataatgagattatgagtgttaatcacattakgacattttttcctaatgacataaacccataagtataatgacatgtttttccaggggtacatccacatacgtaccctcaaataattcccattgccctcttgactggcttatctgtaaacacaaggacacatcaaatcctgcggtgagcggtggtggaagaggcatttcatgcttattaagatacaagcacaacctcctgtttgtttccccagacaaccctggggcaggcgcatttcatctgagacagtgagagtggggaggcctccaaatgcttggcttttcggcccagctctgtcagtca

SEQ ID NO: 81153 - DNA, 601 bp, Human
aagatacaagcacaacctcctgtttgtttccccagacaaccctggggcaggcgcatttcatctgagacagtgagagtggggaggcctccaaatgcttggcttttcggcccagctctgtcagtcacggtgaaaccttgggcaagccacttccgaacctcagtttcctcatctgtaaaatggaaacactgttggtgaagactaaaagaggtgaaaggtgaaaatgcatcatacattgcaaaatgttatgcaagtgttaattaattacttattagtggtcttaagccagacacttaacttcccttttttttttttttttttttttttttgagacagaatcttactctgttaccctggctggaatgcagtggtgcaatctcggctcactgcaacctctgcctcccgagctcaagcgattctcctgcctcagcctcccaagtagctggcattataggcgagtgccaccatgcccgggtaatttttgtattttagtagaggtggggtttcaccatgttggccaggctggtctcaaactcttgacctcaagtgatctgcccaccttggcctccctaagcgctgggattagagggtgagcaccgcgccc

SEQ ID NO: 81154 - DNA, 601 bp, Human
cttcaatcggaagtgaagaattgtgttaatctcatccttgccactcatagctgtggtaacagtaatggaggtgatggtggctgtgtcattgggggccattatgaaagccctcccttcaccacaccagcatatttttcccaaggagggggctctaacagccaggaggctcactttcttatttcagataagtgacagaaagccatggagctagctcagcaaaaaaagggaaattgttataaggatttaaaagttttatcccaagggcagagatacagccaggcatcaggaacaagctagaatyaggggctggaaacctgtaagaaacacaggaaaccctccctcagaatttctgttctttgtgggtctacttcattctccacataaaacaaaatgtcagtcattgccaacagcttcccagaattatgtcctctgaaaccggaatctcatagaccccatctcagaatcccaggggagggagctcattggcttagcttgagtcaggtgttcactgctgaaccaatcaaccgtgaggacacagtatagacaaacgtggctgttcgcatgttgcaatggatggaagacaggaacaggggaaacctaa

SEQ ID NO: 81155 - DNA, 601 bp, Human
gggctggaaacctgtaagaaacacaggaaaccctccctcagaatttctgttctttgtgggtctacttcattctccacataaaacaaaatgtcagtcattgccaacagcttcccagaattatgtcctctgaaaccggaatctcatagaccccatctcagaatcccaggggagggagctcattggcttagcttgagtcaggtgttcactgctgaaccaatcaaccgtgaggacacagtatagacaaacgtggctgttcgcatgttgcaatggatggaagacaggaacaggggaaacctaagasgggtccatcacttcctttttctcaggagtccctgcatccctaatggcttctctctgatctcattcagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacgtgagtaccaaaatcaggggctccgctccatgacaaaatgtggctggggataaggctatagaggtccatccctccataggtccatcc

SEQ ID NO: 81156 - DNA, 601 bp, Human
ggggcctttctcagccaaatcctaagaccgttttccagccccagctgctgtgggagtcaccatgcagctggtcctggcagcaacctggggacctgaagcaggggcaggggcaattgtcccaatttttttttcccagcatcagctgttcccagccacagacacaagcacaacagaacaggccagatcccgaagcatggccagatggcagcagggatccacggggcagcacgcctcgcaaggcagctgggcagaggccctgtgttcatgggagagcagtcgggacaggcacagatgcccggtracgggtttcagaagggggagagccaagcaaccagctgtccttgggtgggggctgcccctggcagcagcggaggagctagtgaaaccttgcagtggccccaacccagggacacagtgtgtgcagcctggagtcacataccactagagccctgggggtgcctgagagcacctgcctggataaacccagacaggtgatgagccaaggtcaggaaatacaagcaaaagagcagagaagcagaggagacaagtggcctggggcattcatcctttcaacaaatgtccattgaatgacagtcacatg

SEQ ID NO: 81157 - DNA, 601 bp, Human
gaagcaggggcaggggcaattgtcccaatttttttttcccagcatcagctgttcccagccacagacacaagcacaacagaacaggccagatcccgaagcatggccagatggcagcagggatccacggggcagcacgcctcgcaaggcagctgggcagaggccctgtgttcatgggagagcagtcgggacaggcacagatgcccggtgacgggtttcagaagggggagagccaagcaaccagctgtccttgggtgggggctgcccctggcagcagcggaggagctagtgaaaccttgcagtrgccccaacccagggacacagtgtgtgcagcctggagtcacataccactagagccctgggggtgcctgagagcacctgcctggataaacccagacaggtgatgagccaaggtcaggaaatacaagcaaaagagcagagaagcagaggagacaagtggcctggggcattcatcctttcaacaaatgtccattgaatgacagtcacatgtgaaccttcagcaatccttagtttttattctttttccggaaggtaatacatactctttgtaaaaatattaaaagactataagagtatcaggtaa

SEQ ID NO: 81158 - DNA, 601 bp, Human
gaagcatggccagatggcagcagggatccacggggcagcacgcctcgcaaggcagctgggcagaggccctgtgttcatgggagagcagtcgggacaggcacagatgcccggtgacgggtttcagaagggggagagccaagcaaccagctgtccttgggtgggggctgcccctggcagcagcggaggagctagtgaaaccttgcagtggccccaacccagggacacagtgtgtgcagcctggagtcacataccactagagccctgggggtgcctgagagcacctgcctggataaacccagayaggtgatgagccaaggtcaggaaatacaagcaaaagagcagagaagcagaggagacaagtggcctggggcattcatcctttcaacaaatgtccattgaatgacagtcacatgtgaaccttcagcaatccttagtttttattctttttccggaaggtaatacatactctttgtaaaaatattaaaagactataagagtatcaggtaaaaaagtaagaagtcccccctcattttacatctccaattccactctccagaggtaatcattggttttgtttttgttttttaagacagagtctcgc

SEQ ID NO: 81159 - DNA, 601 bp, Human
aggaaatacaagcaaaagagcagagaagcagaggagacaagtggcctggggcattcatcctttcaacaaatgtccattgaatgacagtcacatgtgaaccttcagcaatccttagtttttattctttttccggaaggtaatacatactctttgtaaaaatattaaaagactataagagtatcaggtaaaaaagtaagaagtcccccctcattttacatctccaattccactctccagaggtaatcattggttttgtttttgttttttaagacagagtctcgctctgtcacccaggctgaartgcagtggcttgatcgcagctcaatgcaacctccacctcccgggttcaagcgattcttctgcctcagcctcctgagtagctgggattacaggcacacaccaccatgcccaactaatttttgtatttttagtagagatggggtttcaccatgttggccaggctggtctcaaactcctgacctcaggtgatctgcccgccttggcctccaaaagtgctgggattacaggcatgagccactgtgcctggccaagttgtcattgttaacagcttgtgtgtggtctcaactttatgtgcatatat

SEQ ID NO: 81160 - DNA, 601 bp, Human
ctggccaagttgtcattgttaacagcttgtgtgtggtctcaactttatgtgcatatatagctatatatttacgtagatagacactgtcttctatgcaaaaactaagatctgagtcttcatactgttctgcagctgtttttcacttaacaccttatcacattttacatgttagtacatacatgtcattcttttgaacagctaaatagtattccatagtttgagtgtaatgaatgcagctttcatgtttcctatttttcactcttacattgtgcaatgaacatccttggacataattcttgcrcactggtctgagtatttgtgctgtagcagctggatctcctgcagtttacagcactggatcatgaagttggcatatcaaaatgtttaacaggctgggcgcggtggctcacgcctgtaatctgagcactttgggaagctgaggcgagtagatcacttgaggtcagcagtttgagaccagcctggccaacatggtgaaacctcatctctactaaaaatgcaaaaaattagccaggcatggtggtgcatgactataatctcagctacccgggaggctgatgcatgagaatcacttaaacctgca

SEQ ID NO: 81161 - DNA, 601 bp, Human
ctgggcaacagagtgagactgtctcaaaaagaaaacaaacaaacaaataaaaaaaaaaacgtttaacagacactgatcaacagcctctggaaacagttatagccccaaccacagtgcataactgccttgcaaacagcagttttgatttaagaaacaaatgaaatctaaaaatatgccatccacacatttggaatataatttttaggggttcgaaggccccctgacctgaagcccacacaggactcctggctaagaccccctttacaggaagaccctaacaggtcaatgaaaagctgtgatyacatctttttttccgaaacgtcatcagaactcctcaggcaggagctactgtagtgtgggctgcctgtaactcacatgagtagcttagcccaggaggacagagacaggaaactgccatgcacagctctgcggttaggtgaacctgacgattatcttgtgtgtcctgcaggtgattgcaaataactaaccaaaagaagtccctgggactgtttcagacttggaaaggtcacagaaggaaaataatataataaagtgacaactatgcaaatcacatcttgatgagagatttattagcaatccg

SEQ ID NO: 81162 - DNA, 601 bp, Human
tgggcaacagagtgagactgtctcaaaaagaaaacaaacaaacaaataaaaaaaaaaacgtttaacagacactgatcaacagcctctggaaacagttatagccccaaccacagtgcataactgccttgcaaacagcagttttgatttaagaaacaaatgaaatctaaaaatatgccatccacacatttggaatataatttttaggggttcgaaggccccctgacctgaagcccacacaggactcctggctaagaccccctttacaggaagaccctaacaggtcaatgaaaagctgtgatcrcatctttttttccgaaacgtcatcagaactcctcaggcaggagctactgtagtgtgggctgcctgtaactcacatgagtagcttagcccaggaggacagagacaggaaactgccatgcacagctctgcggttaggtgaacctgacgattatcttgtgtgtcctgcaggtgattgcaaataactaaccaaaagaagtccctgggactgtttcagacttggaaaggtcacagaaggaaaataatataataaagtgacaactatgcaaatcacatcttgatgagagatttattagcaatccgt

SEQ ID NO: 81163 - DNA, 601 bp, Human
aacatccagggctgtgggcacagtggcacaaccctgtaatcccagcacttagcactttgggaggccaaggcaggcagatcactcgagtccaggaactcaagaccagcctgagtaacatggcataaccctgtctctactaaaaatacaaaaattaaatgggcgaggtgttacccacctgtagtcccagctactcaggaggctgaggtgggaggatcacttgagctcaggaggtaaagactgcagtgagccaagatcacttagtcgcactccagcctgggcgacagagtgagaccctgtctcaaaaaaaaaaaaaaaaaagaatttcgcatctacgtcaccctgccctactgagacctcaaggacccagcccactttagaacctgacacatgacatcgttgtccaacaatatataaatggagcactaagctccagcgaaggaagtgggctgtagcagcttcctgcactctgcctcctctgcctctctttcctcccctcccagcacagaagcctggatttctgtgcaggcgctgccccatgggatcccggaggttctgccgaaacctcatggcctaggaccaaggctggagcccgtgctccagg

SEQ ID NO: 81164 - DNA, 601 bp, Human
aagtgggctgtagcagcttcctgcactctgcctcctctgcctctctttcctcccctcccagcacagaagcctggatttctgtgcaggcgctgccccatgggatcccggaggttctgccgaaacctcatggcctaggaccaaggctggagcccgtgctccaggcctggccaatcaacacattgcatccccttccccaccacagcgattggctcagggatgggcatgtgacctgagacaggtccaatcagagaggttgcacgactcgtgcagggagctaccgagggctgtcactcattcactgcatgggtgtgaggatgaggggatgtgaggctacaaagcaaaacgagaggggaagggggagacggggttattttgctccccagcatacatctggcaatgtgtggagacatttttagttgcggcaactgtgtggggagggggagggactggcatctagcagcctggggccagggatgctgtcaaactcctgcaaagcacaagacatagacacagccctcaaaacaagaatcatctcgcccaaaatgtcaacactgctgcagttgaggaactctggaccagagatgcggtggtgatcttgtcc

SEQ ID NO: 81165 - DNA, 601 bp, Human
agagttttgctcttgttgcccaggctggagtgcaatggtacaatctcagctcaccacaacttctgcctcccaggttcaagtgattctcctgcctcagcctctgtagtagctgggattacaggcacgcaccaccatgcccggctaattttgtatttttagtagagacagggtttctccatgttggtcaggctggtctctaactcccgacctcaggtaatccacctgcctcggcctcccaaagtgctgggattataggtgtgaaccaccacacccagccaagaggaataatattttaatgcatttttttttttttttggaggcagagtcttactctgtcacccaggctggagtgcagtggcgcagtctcagctaactgcaacctcagcctttcaggttcaagcaattctcctgcctcagcctcctgagtacctagaattagagatgtgtgccaccacaccagcaaattttttttgtattttagtagagacggggtttcaccatgttggccaggcttgtctcaaactcctgacctcaggtgatccacctgcctcggccttccaaagtgctgagcttacaggtgtgagccatcctgcccagccag

SEQ ID NO: 81166 - DNA, 601 bp, Human
ctctgggcctcagtttccccatctgaaaataaaaggttgaaaatttccttgagggcaaatgactcctgttttctctgtgttcatctcattcctccataatactatagagtttgtgctattacaacattaattttaaattgtagtttatagttagtatagtaacaattattatatgatcatagttcttacattatatactttaggccctatgataactaactgactgtcccaggggaggaaagatccccaagtgccaactagtggctcatgaagcagccagttacttgggtctatccctagyattattcaaagccaggcctctggaggtgaccctctccctgggacccctttctcccagctcctccgggatctaccgcgtgatgctgggccagcataacctctacgttgcagagtccggctcgctggccgtcagtgtctctaagattgtggtgcacaaggactggaactccgaccaggtctccaaagggttcgtttctatctgggtgcacttgggggtgaggttgtcagggaacagatgggggtctcacagaggcaaaggtctcaaccccaccacaccccctctgctttttctatagggaag

SEQ ID NO: 81167 - DNA, 601 bp, Human
ctgttttctctgtgttcatctcattcctccataatactatagagtttgtgctattacaacattaattttaaattgtagtttatagttagtatagtaacaattattatatgatcatagttcttacattatatactttaggccctatgataactaactgactgtcccaggggaggaaagatccccaagtgccaactagtggctcatgaagcagccagttacttgggtctatccctagcattattcaaagccaggcctctggaggtgaccctctccctgggacccctttctcccagctcctccrggatctaccgcgtgatgctgggccagcataacctctacgttgcagagtccggctcgctggccgtcagtgtctctaagattgtggtgcacaaggactggaactccgaccaggtctccaaagggttcgtttctatctgggtgcacttgggggtgaggttgtcagggaacagatgggggtctcacagaggcaaaggtctcaaccccaccacaccccctctgctttttctatagggaagagaaaggagctctggcctattagatgtggaaccggctccaaagatgtctggggtggggatgtgac

SEQ ID NO: 81168 - DNA, 601 bp, Human
atatgatcatagttcttacattatatactttaggccctatgataactaactgactgtcccaggggaggaaagatccccaagtgccaactagtggctcatgaagcagccagttacttgggtctatccctagcattattcaaagccaggcctctggaggtgaccctctccctgggacccctttctcccagctcctccgggatctaccgcgtgatgctgggccagcataacctctacgttgcagagtccggctcgctggccgtcagtgtctctaagattgtggtgcacaaggactggaactccraccaggtctccaaagggttcgtttctatctgggtgcacttgggggtgaggttgtcagggaacagatgggggtctcacagaggcaaaggtctcaaccccaccacaccccctctgctttttctatagggaagagaaaggagctctggcctattagatgtggaaccggctccaaagatgtctggggtggggatgtgacctggggagggtgaagcaaagactgccagagcgacctgggtttgctgccagttaagcctgcagggcccctgtccgctgagtgtgtatctacttcatgccaagtcct

SEQ ID NO: 81169 - DNA, 601 bp, Human
ctccctgggacccctttctcccagctcctccgggatctaccgcgtgatgctgggccagcataacctctacgttgcagagtccggctcgctggccgtcagtgtctctaagattgtggtgcacaaggactggaactccgaccaggtctccaaagggttcgtttctatctgggtgcacttgggggtgaggttgtcagggaacagatgggggtctcacagaggcaaaggtctcaaccccaccacaccccctctgctttttctatagggaagagaaaggagctctggcctattagatgtggaaccrgctccaaagatgtctggggtggggatgtgacctggggagggtgaagcaaagactgccagagcgacctgggtttgctgccagttaagcctgcagggcccctgtccgctgagtgtgtatctacttcatgccaagtcctggggacacagagacagtgctgtcgaccctgtgactgtccctggagtaggacacaatctctcctgccttccccctttcaacaaagccctccgcattttcttttttcttttcctttttctttttttgtgagatggagtctcgctctgtcacccaggctgtagtgca

SEQ ID NO: 81170 - DNA, 601 bp, Human
taagattgtggtgcacaaggactggaactccgaccaggtctccaaagggttcgtttctatctgggtgcacttgggggtgaggttgtcagggaacagatgggggtctcacagaggcaaaggtctcaaccccaccacaccccctctgctttttctatagggaagagaaaggagctctggcctattagatgtggaaccggctccaaagatgtctggggtggggatgtgacctggggagggtgaagcaaagactgccagagcgacctgggtttgctgccagttaagcctgcagggcccctgtccrctgagtgtgtatctacttcatgccaagtcctggggacacagagacagtgctgtcgaccctgtgactgtccctggagtaggacacaatctctcctgccttccccctttcaacaaagccctccgcattttcttttttcttttcctttttctttttttgtgagatggagtctcgctctgtcacccaggctgtagtgcagtagcacaatctcagctccctgcaagctccgcctcctgggttcacaccgttctcctgcctcagcctccagagtagctgggactacaagtgcccaccaccacaggc

SEQ ID NO: 81171 - DNA, 601 bp, Human
agggcccctgtccgctgagtgtgtatctacttcatgccaagtcctggggacacagagacagtgctgtcgaccctgtgactgtccctggagtaggacacaatctctcctgccttccccctttcaacaaagccctccgcattttcttttttcttttcctttttctttttttgtgagatggagtctcgctctgtcacccaggctgtagtgcagtagcacaatctcagctccctgcaagctccgcctcctgggttcacaccgttctcctgcctcagcctccagagtagctgggactacaagtgcycaccaccacaggcccggctaatcttttgtatttttagtagagacggagtttcactgtgttagccaggatggtctcgatctcctgacctcatgatccactcgcctcggcctcccaaagtgctggcattacaggctggcattacaggctggcattacaggccaccgtgactggccgaccctctacattttcaaacatgccctgtgggccctgccggtcagagcaacctggggtaacgtacagggaagatgacaaggtctccaagccctccaaagccccatagggcaggaaaagtcaaccctg

SEQ ID NO: 81172 - DNA, 601 bp, Human
ttttacaaagggctttggtaatcctcacctcatatggacttaaagtttctgaaaaagggccgagcccagtggctcacgcctgtaatcccagcacttagggaggaagaggcaggtggatcacctgaggtcaggagttcgagaacaccttggccaacatggtgaaaccccgtctctactaaatacaaaaaattagcccggcgtggtggcacatgcctgtaatcccagctacttgggaggctgagacaggagaatcccttgaacccgggaggcggaggttgcagtgagccaagattgcgccacygcactctaggctgagcaacaagagcaaaactctgtctcaaaaaaaagattctgaaaagaatgctgagcagggattagcataataacctccctgggacttttttttttttttttaaggcagggtctccccatatagttgcatgctggagtgcagtggcacaatctgggctctctacagctttgaccacctggactttggccatcctcccacctcagtttcccaagtagctggactacaggcacgcaccaccacgctcagctaattttaatttttttttgtaaggccggccgcagtggctca

SEQ ID NO: 81173 - DNA, 601 bp, Human
aacatcctggctaacactgtgaaaccccgtctctactaaaagtataacttccctaaggaaaaatgcttatgattttgatatgtcacaggtgtacaatacttttccttttacaaagggctttggtaatcctcacctcatatggacttaaagtttctgaaaaagggccgagcccagtggctcacgcctgtaatcccagcacttagggaggaagaggcaggtggatcacctgaggtcaggagttcgagaacaccttggccaacatggtgaaaccccgtctctactaaatacaaaaaattagccyggcgtggtggcacatgcctgtaatcccagctacttgggaggctgagacaggagaatcccttgaacccgggaggcggaggttgcagtgagccaagattgcgccactgcactctaggctgagcaacaagagcaaaactctgtctcaaaaaaaagattctgaaaagaatgctgagcagggattagcataataacctccctgggacttttttttttttttttaaggcagggtctccccatatagttgcatgctggagtgcagtggcacaatctgggctctctacagctttgaccacctggactt

SEQ ID NO: 81174 - DNA, 601 bp, Human
caatgtccaaggaaacacacgccataaatcacacctggcacatgttgtgaagaaaaccacctaccatcactctccctttcctggacttggaaatatatccttcccttcaagcacgcggaattcccaactgtattttctgatatgagagactaaatctgtttttgaaactgagttctgagggatttcaacatcttgctttgtttaacccacaagtatgcaaacacacacattttcatctccacggtgggtaatcactgcctctgatacggcgtgcggacccgtgagaggtacgtttccacaygatcacgcccttctaaatggaggatgcacactttacagccagcatttgatgaaacgttcctgccttctccaaagttccctagtgtgaactacagaaagggccacccctcgtgagctcaaggctgcagtctgttctgagtgacttgcgactttctccaagaaacacagttgagttttaccaccgtaatgggaaatctacacatcaacccgacctcaactaaagaacaggagggcactgctgccccagcagatctggcctgacacacaaatctgattaacttaagagaagccgtgtcaactg

SEQ ID NO: 81175 - DNA, 601 bp, Human
tgcagctatggggtggatcatttaacagagacatttgatttgctggctggcttctgcctgcagacttccctggcactggctcgctgccacgcaaattaagtaaaaatcaatatcctccggtctgtaaaacatcgtgttagcaatcacactgcaaacaacttatataatacccctcactccatacccaaataatggcgaatgtttttgttaaaaggcaagtctaaaataaacaggaaaaagaaaagaaaagaaaaggcaatcttacaggttcctccttcggcaaaacctttccacgacttgkgtgaggagataatctttctgtgattatgaccaaaccctcctgtcacttagcaacacataattaaggaatatgttttcagatccgctttgcaagcccggccattatcagatgaaattactggagcaacaaatgtcatcgccatgcaaatcagttggttgcaaagaaagaatgtttgactgagagagcaggcacaggccctcggaaaaattatctgacgtccctcctgccgcacatgtatttgagaaagtcaaataatgatgtgatcagacttcaaaaaaatccatgagacaaaatcagaat

SEQ ID NO: 81176 - DNA, 601 bp, Human
aacaatccccaaaccccaaaccaccccactataagcagtgcaacaccgcccatcccgaaggggagaagagagtcaacttccagaagggcgttccttgtccctccgatgggagggaagcacttgagttaggcggcaccagaacgaagatgcgttcaggctggcggcgtcccaaacaagcaacactggatttccagatggccgcgtcctggaccagaggccggcgggactgcccagcctgtgctttcctgaaatgtcaacattatcctccacacacacaccgtctactttccctgctggctcygacagatccaaatgtgactgcggattctgtggaacctactgtacaaaacgtacagccatgtacacagctgaagcgctaccagggacgccagcccctgcccccttcccgacagggtgtgggggataatgccacaatcagcatacgataaggaatgaggagggaaactgcagctatggggtggatcatttaacagagacatttgatttgctggctggcttctgcctgcagacttccctggcactggctcgctgccacgcaaattaagtaaaaatcaatatcctccggtctgtaaaacatcgt

SEQ ID NO: 81177 - DNA, 601 bp, Human
gcaggtagttcgtggactgagaaaaagcaaacatacattaaaaatagccaaagcatccgaaaataaaatagatactgaaaacaatccccaaaccccaaaccaccccactataagcagtgcaacaccgcccatcccgaaggggagaagagagtcaacttccagaagggcgttccttgtccctccgatgggagggaagcacttgagttaggcggcaccagaacgaagatgcgttcaggctggcggcgtcccaaacaagcaacactggatttccagatggccgcgtcctggaccagaggccggygggactgcccagcctgtgctttcctgaaatgtcaacattatcctccacacacacaccgtctactttccctgctggctccgacagatccaaatgtgactgcggattctgtggaacctactgtacaaaacgtacagccatgtacacagctgaagcgctaccagggacgccagcccctgcccccttcccgacagggtgtgggggataatgccacaatcagcatacgataaggaatgaggagggaaactgcagctatggggtggatcatttaacagagacatttgatttgctggctggcttctg

SEQ ID NO: 81178 - DNA, 601 bp, Human
aagaggtttccttgctcccttacaactctctctggctggactgcatggccagcacacaggaagggctggactcatccctctgctggtctgcagggccagcctggggtcacagcccctggacctcacccccaaatgtccttgtgctctgagatgggggaagcctgccgaaggtttaagggtcaagaccctcaagagcagtgcgtcctctgccccaggacagacctcaaggtgcagaggagtctcaaacaagaggcaaggctgcttgaggactcagcagcaggggtgtgggccgatggcggcraccctctatacagattctgatagggctaaaattattgatggaggtgctttctacctaggagatcagcgttcacacctccagttgctggaaaccgaggccacacgaaaagaagccatgagagtgaccagctctggtgacaggtaactgtcacaaccatcagcctcctcaacagcccctccacacagaccacgcgctcctccctccatcctggagtcctcaggcagtgaccctaagcaactagacaggggtcacatgtgcccccattaatccagttgcatcaagaaaaacggctggaagaaa

SEQ ID NO: 81179 - DNA, 601 bp, Human
gacctaccccctttgacagacatggaaatagaagcacagagaactcaacatacttgcccaaacacaaagcaggtggcactccttcgggccatgcattcaactactttatgctcctgggctgaaatcatattcctggggtctacggcacgtccaggagcctgaaaggggaccaagaaacccagtctagcctagcagaatgagctccatgaacaaagggtgaggccaggttcaggcactcgctgagttcagtctggtaagggggcacaaccaagatgcgaatacttcagggcagcaacgggcrggagggatgatcactgctgttctgccatgaaggcggagggtgatctggcgaggtcacaagaagggctgggagtctcaggaggtcaggcatcagtcacaaccagggcctcagaggcacagaggccagtagcaggtgacttgcccaggggcacactgaatgcagggaacaccgggccatgaaacccaatgactgatcaagtacaaaagccaaacggaaggcccgcagagctcactgatgtcgggtgtgttcaatgttttgctagaaaaggctgagctgtcagcacctgggaaccgttcagct

SEQ ID NO: 81180 - DNA, 601 bp, Human
cactgctctcccagaagcagaggaaacaggttcaagacctaccccctttgacagacatggaaatagaagcacagagaactcaacatacttgcccaaacacaaagcaggtggcactccttcgggccatgcattcaactactttatgctcctgggctgaaatcatattcctggggtctacggcacgtccaggagcctgaaaggggaccaagaaacccagtctagcctagcagaatgagctccatgaacaaagggtgaggccaggttcaggcactcgctgagttcagtctggtaagggggcacraccaagatgcgaatacttcagggcagcaacgggcaggagggatgatcactgctgttctgccatgaaggcggagggtgatctggcgaggtcacaagaagggctgggagtctcaggaggtcaggcatcagtcacaaccagggcctcagaggcacagaggccagtagcaggtgacttgcccaggggcacactgaatgcagggaacaccgggccatgaaacccaatgactgatcaagtacaaaagccaaacggaaggcccgcagagctcactgatgtcgggtgtgttcaatgttttgctagaaa

SEQ ID NO: 81181 - DNA, 601 bp, Human
tctctgctcactgctctcccagaagcagaggaaacaggttcaagacctaccccctttgacagacatggaaatagaagcacagagaactcaacatacttgcccaaacacaaagcaggtggcactccttcgggccatgcattcaactactttatgctcctgggctgaaatcatattcctggggtctacggcacgtccaggagcctgaaaggggaccaagaaacccagtctagcctagcagaatgagctccatgaacaaagggtgaggccaggttcaggcactcgctgagttcagtctggtaagggggcacaaccaagatgcgaatacttcagggcagcaacgggcaggagggatgatcactgctgttctgccatgaaggcggagggtgatctggcgaggtcacaagaagggctgggagtctcaggaggtcaggcatcagtcacaaccagggcctcagaggcacagaggccagtagcaggtgacttgcccaggggcacactgaatgcagggaacaccgggccatgaaacccaatgactgatcaagtacaaaagccaaacggaaggcccgcagagctcactgatgtcgggtgtgttcaatgtttt

SEQ ID NO: 81182 - DNA, 601 bp, Human
atgacccaggaagaccctcaactcaagcactgaggttgacagagctgaaatgtgacttgtggagccccaggatggacactggacactcaagagcaaaggccacatttgaaagtagagttaaagcaaaatagcgtaggggcccattggttgtttttatggccaggtgaacatggggccactcacctggtctgtggaatctgctcaggtacttatgcccttggctccgcaaaccttccaggaaaataggaaccataccttggccaagatcaacagcttttaaagatttcagaggagcaacaawccctggaggggtttaggaggccctgagcttggccatgcacagagttccaggtgtgatgtggttctcacagcactgggtgggggttggggggatgggatggggacagcacagccacacaaaactattatctagaaactgaagctatggccccatgacctgcttcctggaaagcagagggtccgctggccaagacctccctactccatgtggaactgctttctaaaccaggaagacagaacgcccctgtagacatgaggaggtcagtcaacgcgggccttgtggagacagacagaagagggt

SEQ ID NO: 81183 - DNA, 601 bp, Human
aactagaaagccctttgttgaagccagcctcagagtgggaaacacacacctgacaactgcacgtttaatcacactcgtttctacatcgctaacgtgggctaattagttatggattacaagtactatttctctttcataaacttaccaaaaaaacctctcccacgtatgagcaaggaatctgtgaaaaagctttagaattctggcttcgtatgttcttgggggtaaataaatttgtgccaaacacctgaaaagctttcctgttaatatatgttggctttctcacttaaaaaaaaaaaccacrtctttcttccttagaatgttagtttccaaatgcaagaagtctggcgtgaagctctaattttgctctacccagcccagctctccacagctcagcttctgcaaagcacaaagcaaacactgggacaactggctgaatgggacccctacctcacaccatatgcagaactttactcaaagcagatcaagacctcaatgtcagagctaaaactaacattcctggaggacaacataagaatatatcttcatgaccctcgattaagcaatggtttcttagatgtcacaccaacggcataagcaaata

SEQ ID NO: 81184 - DNA, 601 bp, Human
ctggggaccctgagcttgccatgcacacagctccggtgtgatgcggttctcagagccgtggggggcaggtagggtgggcaccatcaccccagtgttacccatgggaagcgagcctcagagcccatcatgatgactgctgctccagagcccgtcatgactcttgctccagagcccagccactttgtcctgtttcctcttgctgacacagaccttggcttccagctcggactggtgtctcctccccaagtgtataccattgttgattttcccttgctgtgctaatgcaccgtgcctgaggatyatcatggcatgggccaccccctgctgtgggactcagggtagggggtgaacctctctgagtctgtcagaggaaaaatgtccagagtcttcctgggatttcagatgggggatcatccttgtcaaatgctccacaataggccaggtgcagtggctcacgcctgtaatcccaacactttgggaggctgaggcggggggatcacctgaggtcaggagtttgagaccagcctggccaacatggagaaatcccatctctactaatacaaaaattaaccaggtatggtagtgggcacctgtggtctca

SEQ ID NO: 81185 - DNA, 601 bp, Human
ccatgctgttttggttactgtagccttgtagcatagtttgaaaggtagcatgatgcctccagctttgttctttttgcttaggattgtcttggctatgtgggcccttctttggttccatatgaagtttaaagtagttttttccaattctgtgaagaaagtcagtggtagcttgatggggatagcattgaatctgtaaattactttgggcagtatggccattttcacaatattgattcttcctatccatgagcatggaatgtttttccatttgtttgtgtcctctcttatttccttgagcagyggtttgtagttctccttggagaggtccttcatatcccttgtaagttgtattcctaggtattttcttcttttagtagcagttgtgaatgggagttcactcatgatttggctctctgttattggtgtataggaatgcttgtgatttttgcacattgattttgtatcctgagactttgctgaagttgtttatcagcttaaggagattttgggctgagacaatggggttttctaaatatatgatcatgtcatctgcaaaaagagacaattgacttcctcttttcctatttgaatatgctttctt

SEQ ID NO: 81186 - DNA, 601 bp, Human
catgctgttttggttactgtagccttgtagcatagtttgaaaggtagcatgatgcctccagctttgttctttttgcttaggattgtcttggctatgtgggcccttctttggttccatatgaagtttaaagtagttttttccaattctgtgaagaaagtcagtggtagcttgatggggatagcattgaatctgtaaattactttgggcagtatggccattttcacaatattgattcttcctatccatgagcatggaatgtttttccatttgtttgtgtcctctcttatttccttgagcagtrgtttgtagttctccttggagaggtccttcatatcccttgtaagttgtattcctaggtattttcttcttttagtagcagttgtgaatgggagttcactcatgatttggctctctgttattggtgtataggaatgcttgtgatttttgcacattgattttgtatcctgagactttgctgaagttgtttatcagcttaaggagattttgggctgagacaatggggttttctaaatatatgatcatgtcatctgcaaaaagagacaattgacttcctcttttcctatttgaatatgctttcttt

SEQ ID NO: 81187 - DNA, 601 bp, Human
tttccttgagcagtggtttgtagttctccttggagaggtccttcatatcccttgtaagttgtattcctaggtattttcttcttttagtagcagttgtgaatgggagttcactcatgatttggctctctgttattggtgtataggaatgcttgtgatttttgcacattgattttgtatcctgagactttgctgaagttgtttatcagcttaaggagattttgggctgagacaatggggttttctaaatatatgatcatgtcatctgcaaaaagagacaattgacttcctcttttcctatttsaatatgctttctttctttctcttggctgattgccctggccagaacttccaatactatgttgaataggagtggtgagagagggcatccttgccttgtgcgggttttcaaagggaatgcttcctgtttttacccattcagtatggtattggctgtgggtttgtcataaatagctattattttgagatacattccattgatacctagtttatggagagtttttaccatgaacgggtgttgaattttgtcgaaggtcttttctgcatctattgagatcatcatgtagtttttgtcattggttct

SEQ ID NO: 81188 - DNA, 601 bp, Human
ttgtttatcagcttaaggagattttgggctgagacaatggggttttctaaatatatgatcatgtcatctgcaaaaagagacaattgacttcctcttttcctatttgaatatgctttctttctttctcttggctgattgccctggccagaacttccaatactatgttgaataggagtggtgagagagggcatccttgccttgtgcgggttttcaaagggaatgcttcctgtttttacccattcagtatggtattggctgtgggtttgtcataaatagctattattttgagatacattccatygatacctagtttatggagagtttttaccatgaacgggtgttgaattttgtcgaaggtcttttctgcatctattgagatcatcatgtagtttttgtcattggttctgtttatgtgatggattacgtttattgatttgtatatgtcgaaccagccttctatcccagatatgaagctgacttgatcgtggtggataagctttttaatgtgctgctggattcggtttgccagtactttattgaggattttcacattgatgttcatcagagatattggtctgaaattttctttttgttgttgtgt

SEQ ID NO: 81189 - DNA, 601 bp, Human
aagtccctgaatatccatgttaattatatgtctcatttatctgtctaatattgacagtgggttgttaaagtctcccattattgttgtgtgggggtctaagtgtctttgtaggtctgtaagaacttgctttatgaatctgggtgctcctgtattgggtgcatatatatttaggatagttagctgttcttgttgcattgatccctttaccattatgtaatggcctttttttgtctcttttgatctttgttggtttaaagtctgttttatcagagattaggactgcaactcctgcttcttcttygtttttttttttttttgctttccatttgcttggtaaatattcctccgtccctttattttgagcctatgtatgtcttttcacgtgagatgggtctcctgaatacagcatagggatgggtcttgactctttatccaatttgccagtctgtgtcttttaatgggggcatttagcccatttacatttaaggttaatattgttatgtgtgaatttgatcctgacattatgatgttagctgattattttgcccattagttgatgcagcttctttatagtgttgacgggctttacaatttgatatgt

SEQ ID NO: 81190 - DNA, 601 bp, Human
agtccctgaatatccatgttaattatatgtctcatttatctgtctaatattgacagtgggttgttaaagtctcccattattgttgtgtgggggtctaagtgtctttgtaggtctgtaagaacttgctttatgaatctgggtgctcctgtattgggtgcatatatatttaggatagttagctgttcttgttgcattgatccctttaccattatgtaatggcctttttttgtctcttttgatctttgttggtttaaagtctgttttatcagagattaggactgcaactcctgcttcttcttcktttttttttttttttgctttccatttgcttggtaaatattcctccgtccctttattttgagcctatgtatgtcttttcacgtgagatgggtctcctgaatacagcatagggatgggtcttgactctttatccaatttgccagtctgtgtcttttaatgggggcatttagcccatttacatttaaggttaatattgttatgtgtgaatttgatcctgacattatgatgttagctgattattttgcccattagttgatgcagcttctttatagtgttgacgggctttacaatttgatatgtt

SEQ ID NO: 81191 - DNA, 601 bp, Human
gttatgtgtgaatttgatcctgacattatgatgttagctgattattttgcccattagttgatgcagcttctttatagtgttgacgggctttacaatttgatatgtttttgcagtggctggtactggttgttcctttccatatttagtgcttccttcaggaggtcttgtaaggcaggcctggtggtgacaaagtctctcagcatttgcttgtctataatggattttatttctcctttacttatgaagcttagtttggctggatatgaaattctgggttgaaaatttttttctttaagaatgytgaatattggcccccactctcttttggcttgtagggtttctgcagagacagctgctctttgtctgatgggcttccctttgtgggtaacccgacctttctgtctagctgcccttaacattttttccttcatttcaacctaggtgaatctgacgattatgtgtctgacgattatgtgtcttgcccttcttaaggagtatctttgtggtgttctctgtatttcctgaatttgaatgttggcctgtcttgctaggttggagaagttctcctggataatatcctgaagagtgttttccaacttgg

SEQ ID NO: 81192 - DNA, 601 bp, Human
tctgtatttcctgaatttgaatgttggcctgtcttgctaggttggagaagttctcctggataatatcctgaagagtgttttccaacttggttccattctccccatcactttcaggtacaccaatcaaatgtagatttggtcttttcacatagttccatgtttcttggaggctttgttcattcctttttattcttttttctctaatcttgtcttcttgctttgtatcattaagttgatcttcaatctcatatcctttcttccacttgatcgatttggctcttgatacttgtgtatgcttcaygaagttcttgtgctatgtttttcagctccatcaggtcatttatattctcctctaaagtggttattctaggtagcaattcatctaaccttttttcaaggttcttagcttccttgcattgggttagaacatgcttctttagctcggaggagtttattattacccaccttctgaagcgtacttctgtcagttcatcaaactcattctctgtccagttttgttcccttgctggcgaggagttgtgatcctttggaggagaagtggcattctggtttttggaattttcagcctttttgtgctggt

SEQ ID NO: 81193 - DNA, 601 bp, Human
ttcattcctttttattcttttttctctaatcttgtcttcttgctttgtatcattaagttgatcttcaatctcatatcctttcttccacttgatcgatttggctcttgatacttgtgtatgcttcacgaagttcttgtgctatgtttttcagctccatcaggtcatttatattctcctctaaagtggttattctaggtagcaattcatctaaccttttttcaaggttcttagcttccttgcattgggttagaacatgcttctttagctcggaggagtttattattacccaccttctgaagcstacttctgtcagttcatcaaactcattctctgtccagttttgttcccttgctggcgaggagttgtgatcctttggaggagaagtggcattctggtttttggaattttcagcctttttgtgctggtttctccctatctttgtggatttatctacctttggtctttgatgttggtgaccttcggatggggtctctgagtggacatgctcttcctttctgtttgttagttttccttctaacagtcggacccctctgctgcaggtctgctggagtttgcaggaggtccactccagaccctgttt

SEQ ID NO: 81194 - DNA, 601 bp, Human
atattctcctctaaagtggttattctaggtagcaattcatctaaccttttttcaaggttcttagcttccttgcattgggttagaacatgcttctttagctcggaggagtttattattacccaccttctgaagcgtacttctgtcagttcatcaaactcattctctgtccagttttgttcccttgctggcgaggagttgtgatcctttggaggagaagtggcattctggtttttggaattttcagcctttttgtgctggtttctccctatctttgtggatttatctacctttggtctttgakgttggtgaccttcggatggggtctctgagtggacatgctcttcctttctgtttgttagttttccttctaacagtcggacccctctgctgcaggtctgctggagtttgcaggaggtccactccagaccctgtttgcctgggtatcaccagcggaggctgcagaacagcaaagattgctgcctgttctttcctctggaagctttgtcccagaggggcacctgccagatgccagccagagctctcctgtatgaggtgtctgtcagcccctactgggaggtatctcccagtcaggatacatggg

SEQ ID NO: 81195 - DNA, 601 bp, Human
agtggttattctaggtagcaattcatctaaccttttttcaaggttcttagcttccttgcattgggttagaacatgcttctttagctcggaggagtttattattacccaccttctgaagcgtacttctgtcagttcatcaaactcattctctgtccagttttgttcccttgctggcgaggagttgtgatcctttggaggagaagtggcattctggtttttggaattttcagcctttttgtgctggtttctccctatctttgtggatttatctacctttggtctttgatgttggtgaccttcrgatggggtctctgagtggacatgctcttcctttctgtttgttagttttccttctaacagtcggacccctctgctgcaggtctgctggagtttgcaggaggtccactccagaccctgtttgcctgggtatcaccagcggaggctgcagaacagcaaagattgctgcctgttctttcctctggaagctttgtcccagaggggcacctgccagatgccagccagagctctcctgtatgaggtgtctgtcagcccctactgggaggtatctcccagtcaggatacatgggggtcatcgacccac

SEQ ID NO: 81196 - DNA, 601 bp, Human
cgaggatttcaaaccagtggatcttagtttgctgggctccgttggggtgggacctaccgagccagactacttggctccctggcttcagccccctttccaggggagtgaatggttctgtctcactggcgttccagatgccactggggtatggggaaaaaaaaaaaaacaaaaaacctcctgcagctggttcagtgtctgcccaaatggccgcccagttttgtgcttgaaacctagggccctggagaggtaggcaccagagggaatctcctggtctgcgggttgtgaagactgtcggaaaagkgcagtatctgggccggagtgcacagttcctcaggttcagtccctcatggcttcccttgggtaggggagaaaattccctgactccttgcacttctcgatcgaggcgacaccccaccctgcttcggctcaccctccgtgagctgcacccaccgtccaagcagtcccagtgagaagaaccaggtacctcagttggaaatgcagaaatcacccaccttctgtgtcgatctcgctgggagctgcagactggagctgttcctattcggccatctaataggtgatatgtttttatcgctgtatgaca

SEQ ID NO: 81197 - DNA, 601 bp, Human
cacatcgtatactgatggtccctgatttacaacagttcaacttacaatttttcaactttacagatggtgtgaaagcaggacacattcagtagaaactataattgaaattttgaattttttaatcttttcctaggctaacaatatggggtatgataatctctcaagatgtatagagcagtgaggcacagctctcagtcagccatgcgatcataggggtcaacaactgatactctatggtgtgtattttttatttgttttcaacttacaatgagtttatcagaatgtaacctcatcataatttgagaagcatctgtatttgcccctgaaaacttgcccctatatttttttctaagagttttgtagtttttgttcttacatttggtctttaatacattttgagttattttttgtatatggtgtgagataaggatccaacttcattcttttgcgcgtggctcataggtattcttaaactattaaaaagagtaaattttaaggcaatccaccttgtgttagttccactttgctccttatgtttggctgcaattagtcttagcaaagcaggaattcacatttagatagccgtcatgtggccacctct

SEQ ID NO: 81198 - DNA, 601 bp, Human
atgataatctctcaagatgtatagagcagtgaggcacagctctcagtcagccatgcgatcataggggtcaacaactgatactctatggtgtgtattttttatttgttttcaacttacaatgagtttatcagaatgtaacctcatcataatttgagaagcatctgtatttgcccctgaaaacttgcccctatatttttttctaagagttttgtagtttttgttcttacatttggtctttaatacattttgagttattttttgtatatggtgtgagataaggatccaacttcattcttttgcrcgtggctcataggtattcttaaactattaaaaagagtaaattttaaggcaatccaccttgtgttagttccactttgctccttatgtttggctgcaattagtcttagcaaagcaggaattcacatttagatagccgtcatgtggccacctctgttcatgttctattaacttttaaataggtcactgatgttaagaacaatgatgtcaaaacatatgcctgatttggtgtaccatataatctagttctgatcttgtttaggctttcctgacaaagacaactttactttttagaagctgctgg

SEQ ID NO: 81199 - DNA, 601 bp, Human
caaagcaggaattcacatttagatagccgtcatgtggccacctctgttcatgttctattaacttttaaataggtcactgatgttaagaacaatgatgtcaaaacatatgcctgatttggtgtaccatataatctagttctgatcttgtttaggctttcctgacaaagacaactttactttttagaagctgctggcagaaaaggcttttcaaaccccaacagtcatcccagggcagctgtgatactgaaaactggcaatgacctctagggtgtacctgagaccagtcattggaaattttttragaggtaaactcagtttgggggcagaaacaggatgaaatgattatagaggcaggagatggaaatgggatgagaaatcctccccaaatgatttcaccattgttatgactgctctcatgatttatatccaaattgaactatctactttattctggctaatttgggcatcatctagcttttaaaaatttttttgtaggtacatagataataggtgtgtatatttatggggtacatgagatgttttgatacaggcatgatgattatttcacatcatggagaatggtgtctccatcccaagcatt

SEQ ID NO: 81200 - DNA, 601 bp, Human
cctgatttcccttcttttgggtagataccagcagtgggattgctggatcatgtggtagctcaatttttatttttgaggaactgccaaactgttctccatagtggttgtactaatatacattctcaccaacagtgttcaagggttcccttttctccacatccttgccagcgtttgttactgccttttagatataagcgattataactgcagtgaggtaatatctcactgtagttttgatttgcatttctctgatgatcattgatgaacactttttgatatgcctgtttgccatctgtatgtygcctttcgagaaatgtctgttcaaatcttttgcccatttttaattttgattactacaccttttcctaatattctggttgttaatcccttgtcagatgggtagtttgcaaatattttctcccattctgtgggttgtcttgactttgttgttttactgtgcaaaagcttttaacttgatatgatcctatttttccattttgctttggttgcttgtaggatattgctcatgaattcatttatttttatttttatttatttttgagatggagtcttgctctgttgcccaggctggagtacagta

SEQ ID NO: 81201 - DNA, 601 bp, Human
taatattctggttgttaatcccttgtcagatgggtagtttgcaaatattttctcccattctgtgggttgtcttgactttgttgttttactgtgcaaaagcttttaacttgatatgatcctatttttccattttgctttggttgcttgtaggatattgctcatgaattcatttatttttatttttatttatttttgagatggagtcttgctctgttgcccaggctggagtacagtagcatgatcttggcttactgcaatctctgctttctgggttcaagtgattctcctgcgtcagcctccygagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattattattattttttaattttagtcttaatttcaaaagtttttggggaataggtagtgtttggtcacatggaaaagttgtttagtggtgactgctgagattttggtgcacccattacctt

SEQ ID NO: 81202 - DNA, 601 bp, Human
atttatttttgagatggagtcttgctctgttgcccaggctggagtacagtagcatgatcttggcttactgcaatctctgctttctgggttcaagtgattctcctgcgtcagcctcccgagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattawtattattttttaattttagtcttaatttcaaaagtttttggggaataggtagtgtttggtcacatggaaaagttgtttagtggtgactgctgagattttggtgcacccattaccttagcattgtacactgtacccaatgtgtagtcttttatccctcaccctcttccacccttcccccaggtccccaattccattatattgctcttatccctttgcatcttcatagctcagctcctgcttataagtgagaagatataatgtttggttttccattcctgagagttatttcacttagaataa

SEQ ID NO: 81203 - DNA, 601 bp, Human
agatggagtcttgctctgttgcccaggctggagtacagtagcatgatcttggcttactgcaatctctgctttctgggttcaagtgattctcctgcgtcagcctcccgagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattattattatttttwaattttagtcttaatttcaaaagtttttggggaataggtagtgtttggtcacatggaaaagttgtttagtggtgactgctgagattttggtgcacccattaccttagcattgtacactgtacccaatgtgtagtcttttatccctcaccctcttccacccttcccccaggtccccaattccattatattgctcttatccctttgcatcttcatagctcagctcctgcttataagtgagaagatataatgtttggttttccattcctgagagttatttcacttagaataatggtctccaac

SEQ ID NO: 81204 - DNA, 601 bp, Human
gtcttgctctgttgcccaggctggagtacagtagcatgatcttggcttactgcaatctctgctttctgggttcaagtgattctcctgcgtcagcctcccgagtagctgggactacaggcatgagctaccacacccagctaatttttgtatttttggtatagatgggtcttcaccgtgttggccagcctggtctcgaactcctgacctcaagtcatccacctgcctcagcctcccaaagtgctgggattacaggcatgagccactgtgcgtggccaagaattattattattttttaattttwgtcttaatttcaaaagtttttggggaataggtagtgtttggtcacatggaaaagttgtttagtggtgactgctgagattttggtgcacccattaccttagcattgtacactgtacccaatgtgtagtcttttatccctcaccctcttccacccttcccccaggtccccaattccattatattgctcttatccctttgcatcttcatagctcagctcctgcttataagtgagaagatataatgtttggttttccattcctgagagttatttcacttagaataatggtctccaactccatcc

SEQ ID NO: 81205 - DNA, 601 bp, Human
cttggtcatgatctctttgcctaagacaatgtctagaagagtttttctgatttatcttctagaatttttctggtttcaggtcttagatttaagtctttgatccatcttgagttgatttttgtatacggtgagagatgaggatccagcttcattgttctacatgtggcttgccaattatcccagcaccatttgttgaacagggtgtcctttccccactttatgtttttatttgtgttgttgaagatcagttgtctgtacatatttggccttatttctgggttctctattctgttccattggkgtacctgcctcactctgtcacccaggttggagcacagtggcacaatcccggctcattggaacctccgcctcccaggttcaagtgattctcctgcctcagcctcctgagtaggtgggattacaggcatctaccgccatgcgcagctaatttttgtatttttagtagagacgaggtttcactatgttgaccaggctggtcttgaactcctgacctcaagtgatccacccgcctcggcctcccaaagtgctgggatttcaggcttgagccactgcatccggccctgcctgcctattcttatac

SEQ ID NO: 81206 - DNA, 601 bp, Human
ttttttttttttcattgttttataggcctggtgagatttatgctttaaggaggttctattctggtgtattttgaggttttgtttcaagaattagaactccttttagcatttcttgtagtgctggcttggtagtggcaaattcttagcatttggttgtctgaagactttgtatcttttccttcatttatgaagctttgttttgctggatacagaattcttggctgacaattattttgtttgaagaggctaaagataggaccccaatcccttctggcttatagggtttctcctgagaaatctkctgttaaacagcttttaaaattctttcctttgtcttgactttagataacctgactgtgcctgatcatctttttgcaattattttcccaggtgttctttgagcttcttgtatttggatgtctagatctctagtgaggccagggaagttttccttgattattccctcaaatatgttttccaaactttagatttctcttcatcttcaggaacaccaattattcttatgtttggccatttgacataatcacaaatttattggaggctctgttcattttgtaaattcttttttgtctttgtggat

SEQ ID NO: 81207 - DNA, 601 bp, Human
tgtaagccctatctcctatccaccatcttcccctcaaagtatttatatgtaaatagaatagatgaacagaatctagatccagatgcaaatctgaaatccattccctgcctgttgaactttcacttcttcaggaaacaaattctctgctctttagccccaaacctctgccatgatggcagtgcccatagggacactctcaagaaatttttgcccagacccatgtcttggcgatattccccaatgttttcttgtagtagtttcacagtttgaggtcttaggtttaagtctttaatccattttwtttgatttttgtatctggtgagagatagtggtctagtttcattcttctgcatatggatatctagttttcccagcaccatttattgaagtcttttccccagtgtatgttcttggcagtttgttgaaaatgagttcactgtaggtgtgtggatttgtttctggggtctctattctgttctagtggtctatgtgtctgtttcttttctttctttcttttttgttttgagacagagtcttgctctgtcgcccaggctggagtgcaatggcgtgatctcggctcactgcaagctccgcctcccag

SEQ ID NO: 81208 - DNA, 601 bp, Human
gcccatagggacactctcaagaaatttttgcccagacccatgtcttggcgatattccccaatgttttcttgtagtagtttcacagtttgaggtcttaggtttaagtctttaatccattttatttgatttttgtatctggtgagagatagtggtctagtttcattcttctgcatatggatatctagttttcccagcaccatttattgaagtcttttccccagtgtatgttcttggcagtttgttgaaaatgagttcactgtaggtgtgtggatttgtttctggggtctctattctgttctaktggtctatgtgtctgtttcttttctttctttcttttttgttttgagacagagtcttgctctgtcgcccaggctggagtgcaatggcgtgatctcggctcactgcaagctccgcctcccaggttcacgccattctcctgtctcagcctcccgagtagctgggactacgggcacccaccatttcgcccggctaattttttgtatttttagtagagatggggtttcactgtgttagccaggatggtcttgatctcctgacctcatgatctgcctgcctcagcctcccaaagtgctgggattac

SEQ ID NO: 81209 - DNA, 601 bp, Human
tctgcatatggatatctagttttcccagcaccatttattgaagtcttttccccagtgtatgttcttggcagtttgttgaaaatgagttcactgtaggtgtgtggatttgtttctggggtctctattctgttctagtggtctatgtgtctgtttcttttctttctttcttttttgttttgagacagagtcttgctctgtcgcccaggctggagtgcaatggcgtgatctcggctcactgcaagctccgcctcccaggttcacgccattctcctgtctcagcctcccgagtagctgggactaygggcacccaccatttcgcccggctaattttttgtatttttagtagagatggggtttcactgtgttagccaggatggtcttgatctcctgacctcatgatctgcctgcctcagcctcccaaagtgctgggattacaggtgtgagccaccatgcctggccctatgtgtctgttcctataccagtaccatgctgttttagttactataactctgtagtgtaatttgaagtcaggtcatgttgattctcccagttttgttctgcttaaaatagctttggctattctgggtcttttgtggttctg

SEQ ID NO: 81210 - DNA, 601 bp, Human
ttctcttgtctgattgctctagctaggacttccagtactatgtttaataacagtggtgactgtgtgttccacatcttagaggaaaggcttgtagttttcccctattcagtatgatactagctatgggtctgtcatatatggcttgtattatgttgaggtatgtttcttctttccccggtttgagggtttttatcatgaaggaacactgaattttatcaagtgcttttttagcatcaattgagatgatcatatggtttttatctttcattctgttaacatgatgtgtcacatttatttgtgytatgttgagccatccttgtatcacatggataaatcccacttagtcatgatgaataatctttccaatgtattgttgaatttggtttactagtattttgttgaagatttttgcatcaatatttatcagagatattggcctacagttttatgtgtctttggttttagtatcagggtaatactggcctcctccatgagtgtagaagtactccctcttcctctattttttttggattagtttgagtatgactgacattagttcttctttaaatgtttggtagaattctgcagtgaagccattggg

SEQ ID NO: 81211 - DNA, 601 bp, Human
tctgaaaagaacccttgttttagggacagaagaactgaagaaaagctgggagaaaacattgctttctcagtggattagggagcagagaaattctagttaggtagaataaaagacttgttattggtctgttcgggttttagtctttccggtttagtcttagtaggctgtatgtgtcttggaatttgcccatttcttctagattttacagtttattggcatatagttactcatcatctagcttttcaataagggattaaaacaatgatgactcactgttgcaagcaagactctgatagaagaytttgcccatactgataaaaggcaaggcgaatccctctcaaacataagagtaactgaaatgaatattccagctgaacagatatagcctacattcaaatgaatagaacatctttagtctcctacaagaaagagatcttatttttgtctggtgcaaggcatgatgtcttgtaagtatgctgaatgattacctgtctttctagaccaaccctggaatggtccccagccatggattcagtcccagatcttatttctttgacaaccctcgaagatatgacagtgatgatgaccttgcctggaacat

SEQ ID NO: 81212 - DNA, 601 bp, Human
cctttttactccttgttagtaacagtgaaagtctttagaaaactttttaagagagctctgaaaagagtccttgttttagggacagaagtactgaagaaaagctgggagaatacatgctttctcagtgatcggggagcagagaaatcctggtcagataggataaaagattgtcgctgagaaaaaagaagaaagctgcccaatgcgctgagccagcagatgtaaagaacgtaagctggaagcaagccaacaaacaagaaggacttcttgaagtcaaaagctgtcctttgggtcactcagattytgagctccacctcttccttaaaactgttcttttccagttaccccactgcatctcctattagttgctttcccctttaaacccatattctgctagagctgtcccaccctctcacctgccagaaatgacttagagctgagggagtcctcactaccgatatggtgaagacaagaccccctttctactacatagaggaacataattataatgaaaacgacttacgtgtattgagaattaactatatattagacactgttctaagcactttacagatgttaactcagtccccacaataggcccacg

SEQ ID NO: 81213 - DNA, 601 bp, Human
agaaaactttttaagagagctctgaaaagagtccttgttttagggacagaagtactgaagaaaagctgggagaatacatgctttctcagtgatcggggagcagagaaatcctggtcagataggataaaagattgtcgctgagaaaaaagaagaaagctgcccaatgcgctgagccagcagatgtaaagaacgtaagctggaagcaagccaacaaacaagaaggacttcttgaagtcaaaagctgtcctttgggtcactcagattctgagctccacctcttccttaaaactgttcttttccmgttaccccactgcatctcctattagttgctttcccctttaaacccatattctgctagagctgtcccaccctctcacctgccagaaatgacttagagctgagggagtcctcactaccgatatggtgaagacaagaccccctttctactacatagaggaacataattataatgaaaacgacttacgtgtattgagaattaactatatattagacactgttctaagcactttacagatgttaactcagtccccacaataggcccacgacgtagttactaatattactcccattctaagatgag

SEQ ID NO: 81214 - DNA, 601 bp, Human
gttactaatattactcccattctaagatgaggaaattgaggcatagaagttacttgtccaaagacaccaccacaggttgtgagctgtactccatgttaggattcagatgcagtttgttgctgaaaacatttcctatgcatagtgactggctgggttctctagtcatgctgtatactctgtgctctaaagagttcagtagagttgtcggtgggcatttcagccctgtgtgtagcatggttttgtgggaaaatggactttaagagccatttaaaagaactttagagttatctatagtttacayaaaaatctcagctctgtctacctaaactagactatgtcatacatactatataatgtttcaagtcactgaaatatttttttctttttaagttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaactt

SEQ ID NO: 81215 - DNA, 601 bp, Human
acccagctaaatatggttctttcttagaggtttcatttttgtcacaaaaatctatgcaaattttgcattctactcaatgataaacttgtgtttgttttcctaaattaaaaacaattgtttttaagtttttatgttcccagataagttattaaacctaccaccataatttttcaagtaaaattcacactccaagaaaatacaatgtagtacgcctgaatttttccataccacttattcagttataatgttaccatggtaagcatttcaccatgatgacatggaactagtttccttcaaattmtaaaaatcccaggggataattaacactagatttctttcttttagaagatggaatccagcatcagttcatcgagtgaggtaaataattttgatattaattctgtgtcccaactaatttaaaaaattatgaaaacttgtaccgtgaggattacatatcccttaaggtctcattgtacaaggcagtgtatatgtggcactattctagttttagtatgtgagtagctatccaaaagaagtaagaaagcaattgtttgtcagagacaaattgacaaaattatttctgggcaaacaatcttatctg

SEQ ID NO: 81216 - DNA, 601 bp, Human
ctcctgacctcaagtgatccactcgccttggcctcccaaagtgctgggattacaggcatgacctattacttcaatgtaattatttttaaaaaaagtgtgacaactatatatgcatttttcatattaatgagggtttggagtagcaataatttgccctatcctcatgttcagttggatgtaaattactaaactagtgccttagtttgttttgtgctgctatagcggaataccacagactaagtaatttataatgaacagaaatttatttggttaacagttgtggaggctgtaagtccaagaytgagaggccaacatctgtcaagctagggccttcttgtttcatcatcccatggtggaagagcaaaaaagaatacacaagagagggtcaaactcagtcaaaacaaactcacccttgcaacagtaagcccactcctatgataatagcattaattaatttgtgagagcagagcccttgtgaactaatcagttcttcaaagtcccacttctcatcactgttgtattgcatgttaagtttccaacatatgatctttgggaaacacattcaaatcatagacacttatttctgtctgtctgtctgtct

SEQ ID NO: 81217 - DNA, 601 bp, Human; identical to SEQ ID NO: 23093

SEQ ID NO: 81218 - DNA, 601 bp, Human; identical to SEQ ID NO: 23094

SEQ ID NO: 81219 - DNA, 601 bp, Human; identical to SEQ ID NO: 23095

SEQ ID NO: 81220 - DNA, 601 bp, Human; identical to SEQ ID NO: 23096

SEQ ID NO: 81221 - DNA, 601 bp, Human; identical to SEQ ID NO: 23097

SEQ ID NO: 81222 - DNA, 601 bp, Human; identical to SEQ ID NO: 23098

SEQ ID NO: 81223 - DNA, 601 bp, Human; identical to SEQ ID NO: 23099

SEQ ID NO: 81224 - DNA, 601 bp, Human; identical to SEQ ID NO: 23100

SEQ ID NO: 81225 - DNA, 601 bp, Human; identical to SEQ ID NO: 23101

SEQ ID NO: 81226 - DNA, 601 bp, Human; identical to SEQ ID NO: 23102

SEQ ID NO: 81227 - DNA, 601 bp, Human; identical to SEQ ID NO: 23103

SEQ ID NO: 81228 - DNA, 601 bp, Human; identical to SEQ ID NO: 23104

SEQ ID NO: 81229 - DNA, 601 bp, Human; identical to SEQ ID NO: 23105

SEQ ID NO: 81230 - DNA, 601 bp, Human; identical to SEQ ID NO: 23106

SEQ ID NO: 81231 - DNA, 601 bp, Human; identical to SEQ ID NO: 23107

SEQ ID NO: 81232 - DNA, 601 bp, Human
ggctgtcagccacacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgrattctgtgtgctggtattgtttcttgttttatgttcatttatttattattcattggctgtaaccaatgtggccggcagtgccagtttacagcacagatacaatcatctctttttatttctataattaatctctggaatccccacagcctccattaacagaaagtctcattgttccaaatgtccttgtgattttcttagtccaaattcctaatgtcacacagagagggtctggagagtgggtcagtccactatgctgttgttctttccactaccacatggtgtggctgttgacccgtcatt

SEQ ID NO: 81233 - DNA, 601 bp, Human
tacctctgtttcctcagatagatgatagaaataaagatatgatattaaggaagctgttaatactgaattttcagaaaagtatccctccataaaatgtatttgggggacaaactgcaggagattatattctggccctatagttattcaaaacgtatttattgattaatctttaaaaggcttagtgaacaatattctagtcagatatctaattcttaaatcctctagaagaattaactaatactataaaatgggtctggatgtagttctgacattattttataacaactggtaagagggagtkactatagcaacaactaaaatgatctcaggaaaacctgtttggccctatgtatggtacattacatcttttcagtaattccactcaaatggagacttttaacaaagcaactgttctcaggggacctattttctcccttaaaattcattatacacatccctggttgatagcagtgtgtctggaggcagaaaccattcttgctttggaaacaattacgtctgtgttatactgagtagggaagctcattaattgtcgacacttacgttcctgataatgggatcagtgtgtaattcttgtttcgct

SEQ ID NO: 81234 - DNA, 601 bp, Human
tccctggtggtgtgcagatgcctcaaagctatcctcacaccacaagggagaggagcgagatcctgctgtcctggagaagtgcagagttagaacagctgtggccacttgcatccaatcatcaatcttgaatcacagggactctttcttaagtaaacattatacctggccgggcacggtggctcacgcctgtaatcccagcactttgggatgccaaagtgggcatatcatctgaggtcaggagttcaagaccagcctggccaacatggcaaaactccgtctttatgaaaaatacaaaaattakccaggcatggtggcaggcgcctgtaatcccagctaattgggaggctgaggctggagaatcccttgaatctaggaggcagaggttgcagtgagctgagatcgtgccattgcactccagcctgggtgacaagagtaaaactctgtctcaaaaaaaaaaaattatacctacattctcttcttatcagagaaaaaaatctacagtgagcttttcaaaaagtttttacaaactttttgccatttaatttcagttaggagttttccctacttctgacttagttgaggggaaatgttcataacatgt

SEQ ID NO: 81235 - DNA, 601 bp, Human
ctttcattagatcttagcttccttgtctgctcttcattcttgcagtattcattcaacaaacattaaaaaaaaaaaaaagcattctatgtgtggaacactctgctagatgctgtggatttagaaatgaaaatacatcccgacccttggaatggaagggaaaggactgaagtaagacagattaagcaggaccgtcagcccagcttgaagcccagataaatacggagaacaagagagagcgagtagtgagagatgagtcccaatgcctcactttggtgacgggtgcgtggtgggcttcatgcascttcttctgataaatgcctccttcagaactggtcaactctaccttggccagtgacccaggtggtcatagtagatttaccaagggaaaatggaaacttttattaggagctcttaggcctcttcacttcatggatttttttttcctttttttttgagatggagttttgccctgtcacccaggctggaatgcagtggtgcaatctcagctcactgcaacctccgcctcccaggttcaagcaattctcctgcctcagcctcccgagtagctgggactacaggtgtgcgccaccacaccaggcta

SEQ ID NO: 81236 - DNA, 601 bp, Human
tctgctagatgctgtggatttagaaatgaaaatacatcccgacccttggaatggaagggaaaggactgaagtaagacagattaagcaggaccgtcagcccagcttgaagcccagataaatacggagaacaagagagagcgagtagtgagagatgagtcccaatgcctcactttggtgacgggtgcgtggtgggcttcatgcagcttcttctgataaatgcctccttcagaactggtcaactctaccttggccagtgacccaggtggtcatagtagatttaccaagggaaaatggaaacttktattaggagctcttaggcctcttcacttcatggatttttttttcctttttttttgagatggagttttgccctgtcacccaggctggaatgcagtggtgcaatctcagctcactgcaacctccgcctcccaggttcaagcaattctcctgcctcagcctcccgagtagctgggactacaggtgtgcgccaccacaccaggctaatttttgtattttttgtaaagacaggttttcaccacgttggccaggctggtctgaactccagacctcaggtgattcacctgtctcagcctcccaaagt

SEQ ID NO: 81237 - DNA, 601 bp, Human; identical to SEQ ID NO: 23725

SEQ ID NO: 81238 - DNA, 601 bp, Human; identical to SEQ ID NO: 23726

SEQ ID NO: 81239 - DNA, 601 bp, Human; identical to SEQ ID NO: 23727

SEQ ID NO: 81240 - DNA, 601 bp, Human; identical to SEQ ID NO: 23728

SEQ ID NO: 81241 - DNA, 601 bp, Human; identical to SEQ ID NO: 23729

SEQ ID NO: 81242 - DNA, 601 bp, Human; identical to SEQ ID NO: 23730

SEQ ID NO: 81243 - DNA, 601 bp, Human; identical to SEQ ID NO: 23731

SEQ ID NO: 81244 - DNA, 601 bp, Human; identical to SEQ ID NO: 23732

SEQ ID NO: 81245 - DNA, 601 bp, Human; identical to SEQ ID NO: 23733

SEQ ID NO: 81246 - DNA, 601 bp, Human; identical to SEQ ID NO: 23734

SEQ ID NO: 81247 - DNA, 601 bp, Human; identical to SEQ ID NO: 23735

SEQ ID NO: 81248 - DNA, 601 bp, Human; identical to SEQ ID NO: 23736

SEQ ID NO: 81249 - DNA, 601 bp, Human; identical to SEQ ID NO: 23737

SEQ ID NO: 81250 - DNA, 601 bp, Human; identical to SEQ ID NO: 23738

SEQ ID NO: 81251 - DNA, 601 bp, Human; identical to SEQ ID NO: 23739

SEQ ID NO: 81252 - DNA, 601 bp, Human; identical to SEQ ID NO: 23740

SEQ ID NO: 81253 - DNA, 601 bp, Human; identical to SEQ ID NO: 23741

SEQ ID NO: 81254 - DNA, 601 bp, Human; identical to SEQ ID NO: 23742

SEQ ID NO: 81255 - DNA, 601 bp, Human; identical to SEQ ID NO: 23743

SEQ ID NO: 81256 - DNA, 601 bp, Human; identical to SEQ ID NO: 23744

SEQ ID NO: 81257 - DNA, 601 bp, Human; identical to SEQ ID NO: 23745

SEQ ID NO: 81258 - DNA, 601 bp, Human; identical to SEQ ID NO: 23746

SEQ ID NO: 81259 - DNA, 601 bp, Human; identical to SEQ ID NO: 23747

SEQ ID NO: 81260 - DNA, 601 bp, Human
gcgtaaaatgcgcagcgcatggccgggttctgtggctcatgcctgtaatcccagtactttgggaggccgaggcaggtggatcaggaggtcaggagatcgagaccagcctggccaacatggtgaaaccccgtctctactaaaaatacaaaaattagctggacgtggtagtgcgtgcctgtaatcccagctactcgggaggctgaggcaggagaatcgcttgaacccgggaggcggaggttgcagtgagtcgagatcttgccactgcactccagcctgggcaacagagccagacttcatctcaaaaaaaaaaaaaaaatgcacagcgcgacggtggtggtacattcccagcgctgggcccgcctccaccgctgcattcaccaccggtctcctgtagcagtcagcacactgcccctcccccgcctgcagccactaatcttctgtgtccaggagtttgcctaggctgggccttccctgttaagggaactatgcaatatgtggtctttaagagacttatttttgcaatcttgaaataattcctgtacttaacctctcacccacattcccatctcactcagtggttgtctgttctctgtctaggcat

SEQ ID NO: 81261 - DNA, 601 bp, Human
atgcctgtaatcccagtactttgggaggccgaggcaggtggatcaggaggtcaggagatcgagaccagcctggccaacatggtgaaaccccgtctctactaaaaatacaaaaattagctggacgtggtagtgcgtgcctgtaatcccagctactcgggaggctgaggcaggagaatcgcttgaacccgggaggcggaggttgcagtgagtcgagatcttgccactgcactccagcctgggcaacagagccagacttcatctcaaaaaaaaaaaaaaaatgcacagcgcgacggtggtggtrcattcccagcgctgggcccgcctccaccgctgcattcaccaccggtctcctgtagcagtcagcacactgcccctcccccgcctgcagccactaatcttctgtgtccaggagtttgcctaggctgggccttccctgttaagggaactatgcaatatgtggtctttaagagacttatttttgcaatcttgaaataattcctgtacttaacctctcacccacattcccatctcactcagtggttgtctgttctctgtctaggcattaggacacttaaaggcctgtgacttgcacatcgtcttc

SEQ ID NO: 81262 - DNA, 601 bp, Human
tcacgccactgccctccagcctagtgacagagcgagagactccttctaaaaaaataaatgaaaagattgcagtgattgcagacatttcttcaggaataatgcaagtcagaacagagtggaatcacacctttgaagtgctgagggcaagggagaagctgactgatagtgtcaggcgtctgtattcacaggctctgcgtctgtggattcaaccaaggatcaaaaatactcagaaaaaaattacttgcaccgaaatgcacagactgctcttccttgtcattattccttaaacaatatggtatawcaagtattcatttagcatgtacatcgcatgaggtattataagtaatctcgatatgtatatattttagaaacagggtctcgctctgtctcccaggctggagtaggataatacggttatagctcactgcagcctcgacctcctgagctcaaccaatcctcctgcatgactctgccgagtagctgggaccacaggcacacaccaccatgccctgctaatttttattttattttattttttgtagagatggtatcttactatgttgcccaggctggtcttgaactcctggcctcaagtgatcct

SEQ ID NO: 81263 - DNA, 601 bp, Human
atgactctgccgagtagctgggaccacaggcacacaccaccatgccctgctaatttttattttattttattttttgtagagatggtatcttactatgttgcccaggctggtcttgaactcctggcctcaagtgatcctcccacctcagcctaccaaattacagagattacaggtgtgagtcatcacgctcgccgctacagatgatttaaagtgtatggaagaatgtgcataggttatatggaaacactatgacattttgcataagggacttgaacattcgtggattttggtacccatggcrggtactggaaccaatcccccagggatactgaggaataactgtagttctatgcccagcaaagatatttttcaaaaacaaaggcaaaataaagacttttttgcacttacaaaagctaaaataatccatcactagcagacttgcagtacaagacatgttccagaagtccttcagacaaaaggaaggtgagactggatagaagtcggggtctccacagaagaatgaagagactggacgggttaaagctatttattacgagccttaccacaaccactgcaatacagcaacaaagggtgatggcta

SEQ ID NO: 81264 - DNA, 601 bp, Human
gagatgtaaaaggtttaaacacgtcaatgagaaagcagagaccagaatggataaaaagtcagaacttggaggccgggcgcggtggctcacgcctgtaatcccagcactctgggaggccgaggcgggcggatcacaaggtcaggagatcaagaccatcctggctaacacggtgaaaccccgtctctactgaaaaatacaaaaaattagccaggcgtgggggcgggcacctgtagtcccaggtactcgggaggctgaggcaggagaatggcgcgaacctgggaggcggaccttgcagtgagcygaggtcccagctctgcactccagcctgggcgacagagtgagactctgtaagtcagaccttggagtgcccgtaagaaactcattttaaagagaaaggatggaaagtgcgcacctccctagcgctgtcgaaaggcagctggaataggcatataaacactaaagtcaatttccaggaggcgggtctgaagaaaaagaagaaaacaaatactaaagtagatttcagagccaagaattttgccagcgattctggtcatttcatagtgaaatagggggcagaacattttcctgattaaatgcatct

SEQ ID NO: 81265 - DNA, 601 bp, Human
taaagagaaaggatggaaagtgcgcacctccctagcgctgtcgaaaggcagctggaataggcatataaacactaaagtcaatttccaggaggcgggtctgaagaaaaagaagaaaacaaatactaaagtagatttcagagccaagaattttgccagcgattctggtcatttcatagtgaaatagggggcagaacattttcctgattaaatgcatctaattagaaagcttaaaaatacatggagcagggccgggtgcagtggctcacacctgtgatcccagcactttgggaggccgaggcgrgcggatcacttgatgtcaggagttcgagaccagcctggctaacatggcaaaaccccatctttactaaaaatacaaaaattggctgggcatggtggtgtgcgcctgtaatcccagctacttggcaggctgaggcaggagaatcacttgaacttgggaggcagaggttgcagtgaactgatattgtgccactgaactccagcctgggcaacagagcgaaaccctgtctcaaaaaaataataaataaaaaataacaaaacaaaacaaaacaaaccatggagcaggccgggcgcagtggctcac

SEQ ID NO: 81266 - DNA, 601 bp, Human
cgggcgtggtggtgggcacctgtaatcccagctactcgggaggctgaggcaggagagttgcttgaacctgggaggcagaggttgcagtgagtggagattgcaccattgcactccagcctgggtgacagaacgagactccgtctcaaaagagaaaaaagaaaaaaaactgaaggccggttctctgagagaagcaataagatgtatcaacctctggccagactgagcaggaaaaaagagaaaaacaaatgaccagaatcaggaataggcggtgacagcagtaaagattctaaagatactggaygggtgcagtggctcatgcctatactcccaacactttgggaggccagggtgcacaggccgcttaagcttagaagtttataaccagcctgggcaacatggcaaaaccccatctccacgaaaaacaccaacaattagccgggagtggtggcgcatgtctgtgattccagctacttgggaggctggaggtgggaggatcacttgagcctgggaggcagaggctgcagtgagctgtgatcatgccactgcactccagcctgggtgacagtgagaccctgtctcaaaaataaaatgaagaaaaaaa

SEQ ID NO: 81267 - DNA, 601 bp, Human
gaagcaataagatgtatcaacctctggccagactgagcaggaaaaaagagaaaaacaaatgaccagaatcaggaataggcggtgacagcagtaaagattctaaagatactggatgggtgcagtggctcatgcctatactcccaacactttgggaggccagggtgcacaggccgcttaagcttagaagtttataaccagcctgggcaacatggcaaaaccccatctccacgaaaaacaccaacaattagccgggagtggtggcgcatgtctgtgattccagctacttgggaggctggaggtrggaggatcacttgagcctgggaggcagaggctgcagtgagctgtgatcatgccactgcactccagcctgggtgacagtgagaccctgtctcaaaaataaaatgaagaaaaaaagcttctgtagatattgaacgtatattaaggggctattatgaacaactttatggcaataaaatcaacaacttagacaaaatgggcaaattcctcaaaatacataaattacaaaagctcactcaagaataaatagataactttattttctctatatctgttgataaaattgaactggtaattaaggacc

SEQ ID NO: 81268 - DNA, 601 bp, Human
gggaggctggaggtgggaggatcacttgagcctgggaggcagaggctgcagtgagctgtgatcatgccactgcactccagcctgggtgacagtgagaccctgtctcaaaaataaaatgaagaaaaaaagcttctgtagatattgaacgtatattaaggggctattatgaacaactttatggcaataaaatcaacaacttagacaaaatgggcaaattcctcaaaatacataaattacaaaagctcactcaagaataaatagataactttattttctctatatctgttgataaaattgaacyggtaattaaggaccttctcataaagaaaatgcctctaacagatgtcttcacgagctaatcctactaaacatttaaggaagaaataataccagttctattggtaatacgaactcttccaagaaactgaacaggaggggatactttctaaagcattctatgaaacaaacataactctgatatcaaaaccagacaaaacagaactacagagcaatatctgacaggagcaaagatgcaaaagttatttttatttttatttattactttaaaaaaaagtttcaagagacagggtcttgctctgtc

SEQ ID NO: 81269 - DNA, 601 bp, Human
tgtttgtttttgaggcggagtcttgctctgtcacccaggctggagtgcagtggtgcgatctcggctcactgccacctctgcctcctgggttcaaacgattctcctacctcagccacccaagcagctgggattacaggcacatgccacgatgcctggctattttttgtatttttctggtagagacagggtttcaccatgttggccaggctggtctcgagctcctgacctcaagtgatctgcctgcctcggcctcccaaagtgctgggattacaggtgtgaatcaccgtgcccagccgaattwtttttttctttttttttctttttagatggagtctctgtcacccaggctggagtacggtggcacgatgtcggttcactgcaacgtccgcctcctgggttcaagcgattcttctgcctcagcctcccgagtagctgggattacaggcacgtgccaccatgcccagctaatttttttagtagagacggggtttggggtttcaccatgtgagccaggatggtctcgatctcctgacctcatgatccccccgcctcggcctcccaaaatgctgggattacaggcatgagccaccgtgcacggcct

SEQ ID NO: 81270 - DNA, 601 bp, Human
tgccacctctgcctcctgggttcaaacgattctcctacctcagccacccaagcagctgggattacaggcacatgccacgatgcctggctattttttgtatttttctggtagagacagggtttcaccatgttggccaggctggtctcgagctcctgacctcaagtgatctgcctgcctcggcctcccaaagtgctgggattacaggtgtgaatcaccgtgcccagccgaattttttttttctttttttttctttttagatggagtctctgtcacccaggctggagtacggtggcacgatgtyggttcactgcaacgtccgcctcctgggttcaagcgattcttctgcctcagcctcccgagtagctgggattacaggcacgtgccaccatgcccagctaatttttttagtagagacggggtttggggtttcaccatgtgagccaggatggtctcgatctcctgacctcatgatccccccgcctcggcctcccaaaatgctgggattacaggcatgagccaccgtgcacggcctttttttttttttttttttaaatagaggcaaggttcaccatgttgcccagccttgtctccaacaagctca

SEQ ID NO: 81271 - DNA, 601 bp, Human
tttccatgttaaaaccaatggcaggaactgtggtgagtacctcccctaacttcagtttatacacaatgtataggcagcatccaatcgaaccgtccaaatgtgcatctgcttcttgctgaagaggcgggagaagagagaggagatggcggggaccatgggttcgtggcacttgcgatgggcagaagcagaggggcttggggggccctgtgctttcttctttcatgcttccaggcaaattgaacaagggggaagagaaagaactgaggaagaaagagggaggcagggacatctcactggcccrtgtgctggtgaagctgtagacaggaattagcaggacgaggacctgctggtgatggacacagcagctccagctctcgatgctttaaatgcctggcttggagtctgaaaaaggaacctgaaagcctctatgactgccttaaagtaagtccttatctcctgtagccatggggctgagatttctgcaaagcaaacctgaagcctagtctcctggatgatttaattacagcctaaactgcagtttcgactttgcagtgcctcttttgttaaagttagggaagttgggaaagaatgggaacctgac

SEQ ID NO: 81272 - DNA, 601 bp, Human
agatggcggggaccatgggttcgtggcacttgcgatgggcagaagcagaggggcttggggggccctgtgctttcttctttcatgcttccaggcaaattgaacaagggggaagagaaagaactgaggaagaaagagggaggcagggacatctcactggcccgtgtgctggtgaagctgtagacaggaattagcaggacgaggacctgctggtgatggacacagcagctccagctctcgatgctttaaatgcctggcttggagtctgaaaaaggaacctgaaagcctctatgactgccttaamgtaagtccttatctcctgtagccatggggctgagatttctgcaaagcaaacctgaagcctagtctcctggatgatttaattacagcctaaactgcagtttcgactttgcagtgcctcttttgttaaagttagggaagttgggaaagaatgggaacctgacgttgcaatgggggcatgtgggcggcaagccacccaggtgccgaggcaagagaccgagggcacgagctgttccagtgtaataaaatatataaaacaacaagagttataccagatacagatcatagacatgattatatatga

SEQ ID NO: 81273 - DNA, 528 bp, Human
ctggcaccctcacccacaccgcacccacacccacatcggggaagagctccatgatcattcttttctgtaggcgaaaaactgcggcgggaactgctgccatgcagctgggctcccaatgcagtggggatggtggcgctctgggctggcgggagctatcctgccggacgtgattcccagcacagccgtgagcggcagcagaggcgcagtcatctgacccacatagttccygcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccggggccctcggccaagttccagactctggacagacccaggcccctggaatgaaggacagactgagtctccgagaggaaggggccctgctaaatgccaaaaacatgcagctaatcttcccaccgccccttcccaaaggaatcttcctctgtttatcag

SEQ ID NO: 81274 - DNA, 601 bp, Human
cgaaaaactgcggcgggaactgctgccatgcagctgggctcccaatgcagtggggatggtggcgctctgggctggcgggagctatcctgccggacgtgattcccagcacagccgtgagcggcagcagaggcgcagtcatctgacccacatagttcctgcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccsgggccctcggccaagttccagactctggacagacccaggcccctggaatgaaggacagactgagtctccgagaggaaggggccctgctaaatgccaaaaacatgcagctaatcttcccaccgccccttcccaaaggaatcttcctctgtttatcaggagtctgtgcaacgggaatgggaaataatcaggccttttaggaattactagaccctggagctgaaaggacattcatttcaggaggcccagatgccaggcagagctgtggtttatggaggcggacgacggagttggttcaggttt

SEQ ID NO: 81275 - DNA, 601 bp, Human
gctggcgggagctatcctgccggacgtgattcccagcacagccgtgagcggcagcagaggcgcagtcatctgacccacatagttcctgcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccggggccctcggccaagttccagactctggacagacccaggcccctggaatgaaggacagactgagtctccsagaggaaggggccctgctaaatgccaaaaacatgcagctaatcttcccaccgccccttcccaaaggaatcttcctctgtttatcaggagtctgtgcaacgggaatgggaaataatcaggccttttaggaattactagaccctggagctgaaaggacattcatttcaggaggcccagatgccaggcagagctgtggtttatggaggcggacgacggagttggttcaggttttcctctgaggaggcccagtgagcctcccggcctcctgtggaacagacatactcagccaatggcagggtcc

SEQ ID NO: 81276 - DNA, 601 bp, Human
gaggagcaaaccccaggccacagcgtgctcctggagggaccccgattttgtcaaaatttagatgcagagagaaaaagattaaggaaaataccaaattaacgacagcagtgactgctgggtgtgacgttttgggcaggcttggttcttctcccttttgctaggtgtcccacaggaagacggacccagcatgtggggacctgcacccagccagtctcgccctggctcagcctgttcactggcgctgccctgccactgagggctgaggtcactgtccgtctgggcatgtctcatgtggtctttycttttctccccttctggttaggccccctgagctcagccacagccacgatccccactgccgcctcctccctgggactcgctgatgcctggtgtggggagggtgctggctgctttgggtgttaccccccgttggaggcccccgtgccgagttctcgagtgagatggctctttccattttcccccgacagctgcctcggcctctgtgctagaacagggagctacagctcagtgaccctgtggtgccttgtgggcctgtgggtgccagggctccggggcctgggccttttcctgcttggtgtgg

SEQ ID NO: 81277 - DNA, 601 bp, Human
tctttccattttcccccgacagctgcctcggcctctgtgctagaacagggagctacagctcagtgaccctgtggtgccttgtgggcctgtgggtgccagggctccggggcctgggccttttcctgcttggtgtggctgaccgggacgcggccgaccccaggggcatactggagctaggtcttcctcgccatgtttccacagtgagccctttggctgcacaggtcacggtctggagctgttggaggaggctgctcagagctgttgctgccccaccagacacttggccaaggggcctgcaccsgtctgcgcgggaacgtcccaccggcgtctgctcatggctgggctgtggacccatacgcttgttcggaagccaagctctggcccacaggcgaccagaggaagctcgcaggccaggcgccagctccccgagcctgtccctgcagccgcgctgtgtgcaggcacgtgggccaccgcgtctcctccactggcactgctgggtctgggccgccaagcccacctgcccacctgcatcctcagcagcagcacgccccgcagtcggcgggtgcacactctgctgcagcctggatgggctggggcctcg

SEQ ID NO: 81278 - DNA, 601 bp, Human
gacaaagtgtagtccggactagcttttgcacttccacatcatgattaatttattattcatctggtaccttcctattaaactttgtctttagcctgtgaacttttctttcagcttccaacaaaggatttcattgctttaggaatcgaggtgtggctaagtttttacctgggagcaaaggtgatgcaagcgtttctggtgagacctacccttggtttagggtggggagggaccgcataacagaccatctgtagactccttcggaaagcagcagagacgctgcagagggcttttcttagacatyaactgcagacggctggcaggatagaagcagcggctcacttggactttttcaccagggaaatcagagacaatgatggggctcttccccagaactacaggggctctggccatcttcgtggtaagtcctggattttcctaataatcacaaacttccctgcttcctcccttgttaaagaatattatatttgattgcacaatctttattataaattctaaaaggagtgcagtggaaatcaacactttgaaatgaaatcgtgaagattaccaatttccttcttttgttgttttttatgttgtattt

SEQ ID NO: 81279 - DNA, 601 bp, Human
agtatagatggacgggccaaaaggagatctcttgggttgtcagaagagtataatcaaaggcaggcacagttaggatttgcctaggggaaatggacacaccagtatgactagcatgacagtttgctttggagaatctggacatgaattggaaaggcagctgagggtcagattgaaaagtgcattttgtgaaggctcatggaaaccttttacaagtggggagccacccagagttttgaaataatgtggtcatgggggggaaaagcaatgttttctaaagcattctcaagtgggaatgctcatyttttgttgttgcagggtgggttctgaaagttggcagatgtgtttgaaggttttgtaataatccaccatccaatgaccatacatgggttgcccagaacagtgagaaataatagcaaagtcatagacttaaatctctggctatgccactgactcactacaggctttgtttcctcaactgtcaaataagaatcacaccccaccccctgcctaatgaaaatggtcatagtgagaataaagcagcaatgcatgcaaaacaattaaaaagtgctgtgagaaagatgaagtgatttgtaaacccttt

SEQ ID NO: 81280 - DNA, 601 bp, Human
ttttttgttgttgcagggtgggttctgaaagttggcagatgtgtttgaaggttttgtaataatccaccatccaatgaccatacatgggttgcccagaacagtgagaaataatagcaaagtcatagacttaaatctctggctatgccactgactcactacaggctttgtttcctcaactgtcaaataagaatcacaccccaccccctgcctaatgaaaatggtcatagtgagaataaagcagcaatgcatgcaaaacaattaaaaagtgctgtgagaaagatgaagtgatttgtaaaccctytaatttttatcacttgtactatttttagtaatggggtaattcttgataacttcttcacattgtgtcttactatcttaaataaccatggataccagtgttagtaagtcaagaaagggcctgcatttgtcttgagctaaaaagtatatcaaaaacagttgtcgtatcaatttttaaattgacaggaaaaaataaaagctatatttgggaggagaaggcatggggaataactgtctactattgaaaaaaatgtggtatttatcagtttcttgtgcttgtttgatccattttatgcaacgtaaa

SEQ ID NO: 81281 - DNA, 601 bp, Human
agaatatccagggatatttatttttcttagcattctgtcatgatacaaggcttaactttctaaattaattgaatttactctaaaaatcagttattggaaattgaattcttcacaattaaataatttccaagtaatcagatatatatcaactttgttcaattaaggaatttgctttgataaatacaaagtttatcacaatgtttcagagtttttaaattttaaatttcaatatatatagaaagctatgagatattatgaaagatgctaatatgaatgatattacttacctgtgtatatttcrtgacatttttcccaaaaaaatttaataaatacaaaatcatgtttaaaatttggactgatttatttgaattatctaattcattctacaaatttccccaagaatccccattctagaaatcagaagtgtagtcaggccctaggcctggctgggatgagctacctgcatctaatccatagtcttatgttctgtcccctgccacactaaagcatgaggtaaccccaaacaagatctcggccaaactaaagagcaggtgctattatacttgctttttgtttaatctagctacccatatcctcagat

SEQ ID NO: 81282 - DNA, 601 bp, Human
aatgctttaaaaatcatataattaaaatttacaaaataaccagaaaacaaaaagaaagaaaagtacagtaattctcaagataagggaggttttctccatgttggtatttccaatccaggccaccaaaagagacaacttagttcattcaaatcgtcagaaaactatgtaaatatttattggcttgatttagtcattccacagtttatacatatctcaaaacaacatgtacatgataaatatatacaattttgtcaatgaaaatagatttacaaataaaaacacataaattgtttttaaaatrtccaaaattattatattagcaaattaactaaaacaagtagccattatataaatattaactaaaataatttttttaaaaaaatactattctaaataatgtaaggctgtgctgtcctctaaaaatctgaagatcattgcaatattcagaaatgtttcccatcacctacttcctgggaaaacaaatattctaccttattgtgtattagaagaatcattctctgtagggctagtccaagcatgattcatattttcgggatgactctccagttttcctgtaaaggggagcctgcctggcccatcc

SEQ ID NO: 81283 - DNA, 601 bp, Human
caagataagggaggttttctccatgttggtatttccaatccaggccaccaaaagagacaacttagttcattcaaatcgtcagaaaactatgtaaatatttattggcttgatttagtcattccacagtttatacatatctcaaaacaacatgtacatgataaatatatacaattttgtcaatgaaaatagatttacaaataaaaacacataaattgtttttaaaatgtccaaaattattatattagcaaattaactaaaacaagtagccattatataaatattaactaaaataatttttttwaaaaaatactattctaaataatgtaaggctgtgctgtcctctaaaaatctgaagatcattgcaatattcagaaatgtttcccatcacctacttcctgggaaaacaaatattctaccttattgtgtattagaagaatcattctctgtagggctagtccaagcatgattcatattttcgggatgactctccagttttcctgtaaaggggagcctgcctggcccatccctcctctcatgtgtagctgagtcatttttatgcgctgagaaaggaattgtgcagttactacatttatctggtctt

SEQ ID NO: 81284 - DNA, 601 bp, Human
atttattggcttgatttagtcattccacagtttatacatatctcaaaacaacatgtacatgataaatatatacaattttgtcaatgaaaatagatttacaaataaaaacacataaattgtttttaaaatgtccaaaattattatattagcaaattaactaaaacaagtagccattatataaatattaactaaaataatttttttaaaaaaatactattctaaataatgtaaggctgtgctgtcctctaaaaatctgaagatcattgcaatattcagaaatgtttcccatcacctacttccygggaaaacaaatattctaccttattgtgtattagaagaatcattctctgtagggctagtccaagcatgattcatattttcgggatgactctccagttttcctgtaaaggggagcctgcctggcccatccctcctctcatgtgtagctgagtcatttttatgcgctgagaaaggaattgtgcagttactacatttatctggtcttttctaccaagtaactcaaggtactgctttaaaaagagcaacaatgttggaaaataattttgagacatgttataaccacaagtaatggttcttttcc

SEQ ID NO: 81285 - DNA, 601 bp, Human
taaatattaactaaaataatttttttaaaaaaatactattctaaataatgtaaggctgtgctgtcctctaaaaatctgaagatcattgcaatattcagaaatgtttcccatcacctacttcctgggaaaacaaatattctaccttattgtgtattagaagaatcattctctgtagggctagtccaagcatgattcatattttcgggatgactctccagttttcctgtaaaggggagcctgcctggcccatccctcctctcatgtgtagctgagtcatttttatgcgctgagaaaggaattktgcagttactacatttatctggtcttttctaccaagtaactcaaggtactgctttaaaaagagcaacaatgttggaaaataattttgagacatgttataaccacaagtaatggttcttttccatgacaaatttgaacacgcactctttggaatcaaggtttcagctggaatgtctagaagggaagagtcctgacatcttatgtctgacataattactcatttggttcagacttggactagtctattcattataaccctagaaaataaacaatctacattgtttcaagagcaaccatagtc

SEQ ID NO: 81286 - DNA, 601 bp, Human
aaaaaatactattctaaataatgtaaggctgtgctgtcctctaaaaatctgaagatcattgcaatattcagaaatgtttcccatcacctacttcctgggaaaacaaatattctaccttattgtgtattagaagaatcattctctgtagggctagtccaagcatgattcatattttcgggatgactctccagttttcctgtaaaggggagcctgcctggcccatccctcctctcatgtgtagctgagtcatttttatgcgctgagaaaggaattgtgcagttactacatttatctggtcttytctaccaagtaactcaaggtactgctttaaaaagagcaacaatgttggaaaataattttgagacatgttataaccacaagtaatggttcttttccatgacaaatttgaacacgcactctttggaatcaaggtttcagctggaatgtctagaagggaagagtcctgacatcttatgtctgacataattactcatttggttcagacttggactagtctattcattataaccctagaaaataaacaatctacattgtttcaagagcaaccatagtcttttgccaaatagaaatctaaattgac

SEQ ID NO: 81287 - DNA, 601 bp, Human
agagcaacaatgttggaaaataattttgagacatgttataaccacaagtaatggttcttttccatgacaaatttgaacacgcactctttggaatcaaggtttcagctggaatgtctagaagggaagagtcctgacatcttatgtctgacataattactcatttggttcagacttggactagtctattcattataaccctagaaaataaacaatctacattgtttcaagagcaaccatagtcttttgccaaatagaaatctaaattgactgtcatataattttctttgtaccattagtttgktttttttttttttctctttatgacaactttggttagaatttagcagtagttggctcacacctgtaatcccagcactttgggaggccaaggcgggtggatcacctgaggtcaggagttcgagaccagcctaaccaacatggtgaaactccgtctctgctaaagatacaaaattagccgggtgtggtggtgtgcccatgcctgtaatccctgttactcgggaggctaaggcaagagaatcccttgaacccgggagacgaagcttacattgagtcaagatcgcaccattgcactccagccagg

SEQ ID NO: 81288 - DNA, 601 bp, Human
acagaaattctttcatgtgcataaaacaagaaataataaactgtggtaaaccatcatgggctaaatttcatggtacagaatatgtgttgtacaaactcagaaaaagagacatcagtaaagacaatttcatggaggttgttggaacttgatggatctggaaggatgagcaatatttaagtgggtggagtagaaagaggtaatgcatgccaggcagaacagaagatgaaaaatgacacagatgaatgtctcatatgctcttgagaaggtgaagaccctagcctacatggcttcattttactgkcatttaattttttggggccactctgaaaattaagttcaatatttaaattgaagtaatagagcagagatgaacagatccatgtctcactgcaaacagggtttgtgattggaatagcatatcctcatcttttacgttttgttctctaaaccagactggttccattccattcttttcacttgtacaattaaagaaaatgttctgtaattgtagaggactaatacaggattgccttcctacaaatcagttgggtggctgaaggtttttaataatcccctgtggcccctttctgaagcatttcac

SEQ ID NO: 81289 - DNA, 601 bp, Human
acctcatgatctgcccacctcggcctcccaaagtgcttggattacaggcatgagccaccacgcccagcctgttatactgttctaactttacatatatttcacatttttcatgttaaaaagctttaaaattacaataataataagtaaattattttaatacatattttaaccctaccatacaatctctttccctttttgtctctccacttccccctatttaaactaaataaatatcttttgttttttaatgttgtcaggtaaagagggagccttcaggagtagccttgtcaatattaaatgmctttgactttcttttaacattttaacactatcatgtggccacagtctgagcaaatattctaacactaaaatgattagtgcacatcattggttcaggctggttgtcaaaaacaacggtttgattttatttcatattcctagtatctatcaaggcaaaaagtaaatggcacaatgtcaaaaagagtgaatcgaatgaacagatgactttagactatggaagtgggggtggagagggaaaggcttgagtgatggtcacctcaacgtttttggtatttggggctgtagattacttcagattacc

SEQ ID NO: 81290 - DNA, 601 bp, Human
gaaaatcacctaccgaatctctggagtgggaatcgatcagccgccttttggaatctttgttgttgacaaaaacactggagatattaacataacagctatagtcgaccgggaggaaactccaagcttcctggtaagtttgggtcctcaacattgggctacccttctccttgtataccatcgctttagaaagtgacagttttctactggtaaatttagaggagagttcagtacatgcatcagtccaccagcaaataacaatattagtccctccacagagcctcgcctgagggaacacagcagwgggtgcatgagtgagggttgaaatctagcacgccaagtgcttcagtttgccatgacacagcattagcctggtggaaggggcaacttgcccagttggtctgcccagagcaggcacctttttccactttgtctaccctttggggaaacatttcttctttgcacaaaagtgatgtccatgccaacagaggccttatttatacaagttttaatagtatgaaaactgattgcagagtaatactccacattttccctctgttcctagatcacatgtcgggctctaaatgcccaaggactagatgta

SEQ ID NO: 81291 - DNA, 601 bp, Human
tcgatcagccgccttttggaatctttgttgttgacaaaaacactggagatattaacataacagctatagtcgaccgggaggaaactccaagcttcctggtaagtttgggtcctcaacattgggctacccttctccttgtataccatcgctttagaaagtgacagttttctactggtaaatttagaggagagttcagtacatgcatcagtccaccagcaaataacaatattagtccctccacagagcctcgcctgagggaacacagcagagggtgcatgagtgagggttgaaatctagcacrccaagtgcttcagtttgccatgacacagcattagcctggtggaaggggcaacttgcccagttggtctgcccagagcaggcacctttttccactttgtctaccctttggggaaacatttcttctttgcacaaaagtgatgtccatgccaacagaggccttatttatacaagttttaatagtatgaaaactgattgcagagtaatactccacattttccctctgttcctagatcacatgtcgggctctaaatgcccaaggactagatgtagagaaaccacttatactaacggttaaaatttt

SEQ ID NO: 81292 - DNA, 601 bp, Human
tttcaggttataaaggacagagacacactcacattacttggataatttgtggaaaggggagaattatgacaatctatcaagggagaaaattgagatagaatatagcctcaatctcagcaaacgtaaggcttagagagaatcgaagagtttgtatggaaggaagcacagttctacctggttgggagagacagaaagaggtatcacaagtgatatacaattttttgaacatacagatgattttaggatatttaaaaattagcatcaatgtgaacttgtttggaatatttaaagtaaacataaygttaattgttacatattctttaataaacgttttcctgtattcctagactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagaggtacagcaaagcacttgggggaacattcaagattaaagggtttgattataagaaaaccaagagaggtgactccattttacccgaaaa

SEQ ID NO: 81293 - DNA, 601 bp, Human
acaagaaactgggtaactcaaaaagtaacatttagctaaatcattaggtgatcatctaactgtactagaagcaaagataacataagcacaagttacagtggaaaccaagggaagaatgccttagcctatcaacagaaattgggaacatgtctcatggaaacttacagttgagtcttacaaaggagtagaagtgcaccatgagaacatgtttttatcatataaaacagcacttacaaagacatatatgcctaaaatataacggcaccatgcaaaataattgctatattatacagagcaagamcacaggtattttattttattgtgcatagcagatatgcttaagaattatgaaatatgggcctggcacagtggctcacacctgtaatcccagcactttgggaggccgaggcagatggatcacttgaggttgggagttcgagaccagcctgaccaacatgaagaaaccccatctctactaaaaatacaaaattagccgtggtggtgcacacctgtaatcccagctactcgggaggctgagaatcacttgaacccaggaggcagaggttgtggtgagccgagatggcaccattgcactccagcc

SEQ ID NO: 81294 - DNA, 601 bp, Human
agaattatgaaatatgggcctggcacagtggctcacacctgtaatcccagcactttgggaggccgaggcagatggatcacttgaggttgggagttcgagaccagcctgaccaacatgaagaaaccccatctctactaaaaatacaaaattagccgtggtggtgcacacctgtaatcccagctactcgggaggctgagaatcacttgaacccaggaggcagaggttgtggtgagccgagatggcaccattgcactccagcccgggcaacaagagcgaaactccgtctcaaaaaaaaaaaaaagaattatgaaatatggtcatctatgctatgttaattttctgttgctttttataaaagcatatttcaatgtgaacatatattaaatatgaatatactaaatataaaatgagtcattttcattaaatatgtaacattccacatttgaaagaaaactgatttttttaatattatgaaacagatatgtcatgggacgtaacgatggtggatacctaatgattgattcaaaaactgctgaaatcaaatttgtcaaaaatatgaaccgagattctactttcatagttaacaaaacaatcacagctg

SEQ ID NO: 81295 - DNA, 601 bp, Human
tattcattgagtgtatgtgtttccccaagtataaaattaatttatgttgaaggtaataaaaaagataacaccccccaaaagaaataagtatcaaaaagattgccatttgggaaaacaagaaaagaagtagtaagggtaacaacagaaatgacacataatgcccccacagagagatttttatttcattattttttattttcagcatttaaaatttttctttaataaactttaacattttgagtaataaaaatatacaattttttattccaaataaaaaatgtgtgctttagaagcagaaacytttcacacattgattacaagtgaaatcaacacatttaagaaagttactatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactgagttggctacagaaaagagaaatgtaaaagattctccttttttgtac

SEQ ID NO: 81296 - DNA, 601 bp, Human
tgaaggtaataaaaaagataacaccccccaaaagaaataagtatcaaaaagattgccatttgggaaaacaagaaaagaagtagtaagggtaacaacagaaatgacacataatgcccccacagagagatttttatttcattattttttattttcagcatttaaaatttttctttaataaactttaacattttgagtaataaaaatatacaattttttattccaaataaaaaatgtgtgctttagaagcagaaacttttcacacattgattacaagtgaaatcaacacatttaagaaagttaytatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactgagttggctacagaaaagagaaatgtaaaagattctccttttttgtacaactttgttctatacatttctttaactctaaaacattgttcttacag

SEQ ID NO: 81297 - DNA, 601 bp, Human
acaattttttattccaaataaaaaatgtgtgctttagaagcagaaacttttcacacattgattacaagtgaaatcaacacatttaagaaagttactatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactragttggctacagaaaagagaaatgtaaaagattctccttttttgtacaactttgttctatacatttctttaactctaaaacattgttcttacagaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatgg

SEQ ID NO: 81298 - DNA, 601 bp, Human
attttttattccaaataaaaaatgtgtgctttagaagcagaaacttttcacacattgattacaagtgaaatcaacacatttaagaaagttactatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactgagytggctacagaaaagagaaatgtaaaagattctccttttttgtacaactttgttctatacatttctttaactctaaaacattgttcttacagaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagt

SEQ ID NO: 81299 - DNA, 601 bp, Human
tttagaagcagaaacttttcacacattgattacaagtgaaatcaacacatttaagaaagttactatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactgagttggctacagaaaagagaaatgtaaaagaktctccttttttgtacaactttgttctatacatttctttaactctaaaacattgttcttacagaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatggtgagtaacagta

SEQ ID NO: 81300 - DNA, 601 bp, Human
gactaggtgggcaaggcacaatgtcaaaggatatggtgggatcaaaaagattcaacaaatgcaatgctgaaccttacaagaactgtcgtgggatccactttaaaaaggcaacatagcaatgggagatagaaaacagtctatgctcaggactcagataggcaataggccatcaccacaaggaaatcccatatcatagacctgcagctcacgggataagaaccaggaagagcacttgaggtagtagcagccaaagttgaaagtcttgataagtaaaacacaagaacacaaagtcaggaacacwaacactcaaagggccacacaagtccaaggattggtgcagacatacaagagagtggttaagccccagaagaggagtacctgactctaaatgatgtcgcccatcttctttagtgggaaaagcagagtagaactgagtttcatgggagagaataattggcctacctgcaacagagaggacaaggaggcaggtgtagacagatttacccacttgaacccattatagccctcatcactgctcaaacatcactctattatcaaccctattgtttgtggcaactaactctgctaatgaaaataagta

SEQ ID NO: 81301 - DNA, 601 bp, Human
ggtcatgagagctctgtcctcatgcatggattaatggtgttaccatgggagtgggttcattacagtaagagtgagttgttataagggtgagttcagcccccacgtgctctcatgctctcttgtccttccaccttccaccgtgggatgatgaagtccaaaggcctttgtcagattctgacaccttgatattgagcttcccaaccttcaaaactgtgagaaataaatgtgttttctttatgaattatccagtctgtgatattctgttatagcaacacaaaatagactgaaaagacacttcgtyctactgttgatttgcatgattctttctctacagctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgtgtgagt

SEQ ID NO: 81302 - DNA, 601 bp, Human
gcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgtgtgagtagccaatgtttcattctctgttggaccaggtgtcctcatttgcaaaggcctccrtgctgccctgctcatctgtgcaatggggaaagaatattctctgatgttttataggtaaagctaggggaaaatggcattttcagaaagaatctgaaatgtgtaacatgtcgcttgctaacagtctatattcatatagcaacacaagttatatatgtcagacatttagaagacagcacaagataatcaagagaaaagcaaatcatgaagactttctacacactgttagtaatgttcatggtcaaaattatggctttatccaagagtgtggcactttctaagatgttttctctatattcatta

SEQ ID NO: 81303 - DNA, 601 bp, Human
tgagtagccaatgtttcattctctgttggaccaggtgtcctcatttgcaaaggcctccatgctgccctgctcatctgtgcaatggggaaagaatattctctgatgttttataggtaaagctaggggaaaatggcattttcagaaagaatctgaaatgtgtaacatgtcgcttgctaacagtctatattcatatagcaacacaagttatatatgtcagacatttagaagacagcacaagataatcaagagaaaagcaaatcatgaagactttctacacactgttagtaatgttcatggtcamaattatggctttatccaagagtgtggcactttctaagatgttttctctatattcattacatctcatgagattctaagataaaaagagaacactagtcaaacaaagttagggaaatacaaatagggtatcataggctattaagatatcaccacatgctattaatattaattaattaattaacccccactaatattaatcaatagcatatgatattaatattaatatcatatgctattaagatagctaggttctgagaagttattgcttcatctagcatttcctcaaaatagattgccatct

SEQ ID NO: 81304 - DNA, 601 bp, Human
tcatataaatcaaatagtatttgattgtaagaggtctctatttaaaagaacttcctgactaattcttgtataaacaagagaaatccttgctaaattcacactttcttaatttattataaaaatcacagttttagagttaaaattaattatatgattattaattttaaaaccacaaaaagtagagaaaatgtgtagacaactacacatacaaccatcacttcaactgaacagatatgaatgttttgcaatattttttcaggtccctttttttaaaaagaaataaattgctatagatacagcwaattgccacacatgctatatttttcccttccttattctccaaaagcatttactattctaaagttattatacaccatttagtttaagagctgaaattgacactcagagatttggtttttcaatatcgtattaatcaagttcaagaaccagaaatttttaagtacctctatgtgaatcactatgctagcttctagctgaaaaggaaacttgattttggttttcatgcatgtctaactataggggaaaaataccatgataaagctgtaatagaaattactacaaaggggtaattacagaacat

SEQ ID NO: 81305 - DNA, 601 bp, Human
tcttgtaatgttatcatttacaaatttgcaaagggccacatgtcactatattgctctgaaatctggttcacttttaaatgaatttatttttcacatggtttgcaggaaatcacaaatatttgtgtgcctcctgtaacagccaatggagccgatttcatggaaagttctggtaagtggacataaaatgtttgaaagcaatggtgagttaagtggtaaatattaaaaaataagaagtgttcaaactatcttcttaataatttgcatctgtgtgcacatgtcaggagctgttaccactgaaatsgagaaaagctgttttaatatttttatattagtcaattccctgacatgtctggcttcaataagttaatttatccattgatgccaccattgtcaatatctaaagatctgttatactttttccaaactttagtgacgtgtagttctcaggcaatcaattactaattttttaattaggaaagacttcacacatatagaaaaatgtaagggaaaatataacgaacatctatgtatccaccacccaactttgtcttttccaaacattagtcatattttcagttaaagtctcatgtgcacatccttg

SEQ ID NO: 81306 - DNA, 601 bp, Human
caagacaactcatcgccttaaaattccccaagtatggcacaaaaagaatggggtccactgaccccattctaaaaaagcgacctaggaccctagaaaacacacattgttggactcaatcacattccctgctgctggctcctccatatttttacaaccagttattatacccgagagtgtttgaataaaactacgattaagcactcagtttaggcttaaagacttaacattaaatggataaagctgtcatgaacactcaagaaagcgactagggcatcccgggccatcacactaattttgctaygtctatttaatgcaatcttttacgttattaacaaacatgcattaacaaaatgcatgcattaacaaaactcacataccaaagccatgccctgaagcagtttgacacgtctgaaataacatttaaaacaaaacgcttttctgcgggcccctgtttaaacagcttccaaatcccagaagtaacatcggataacagcctgcgctggctgtggtgtgaccaggggaagcgagggtgtgtctcggtgcttaccgatgcctggggccacatagatgaagtacagacaggacgaagagagggagaaga

SEQ ID NO: 81307 - DNA, 601 bp, Human
ttgggatacgtcaacgtttcacaatgcatttcttcttaaacatcatcatctgagtttatacacctcactgaatccaaaaattaattattaaagaaaaagtctcatagtaattttaagaaatgaagcagtctggattaggtttccatcttccttccctgctgcaattcactgcaataatctactacactcaagacaatgccctgatcattccatctgaaaattctgcaggtgttttcactctgtaaggggcattacatttttagctaactcggaacaaagagcactggctcaaacgaccacwgtgtgtaaggagaaatgagaggagatgctcactgttactaagtaattgaacattaaatacgtaatagccaggaaaaactcagaaaagttttggaaatatgacatattttaatatgcatgtgaagttcataattctcattcactagaattaacgccgcattggctccttttcaacaaatgggggacgaggaattcggatatttaataaagaagttaattcaagcagttttacaaaagtgtattttgcaccaaaggccaaaaaatgataaaccggttaacattttaaactacaagttccctt

SEQ ID NO: 81308 - DNA, 601 bp, Human
tgagcaaagtgagcctgacacttcaagaaaaactgacagtatttgttgccaatgataaaattcaaactttcaagcgaaaatctgaattttggaaaactgcttcccaatacttaaagatacaaaagattaaaaaggaggctttttttggctaaatggtacagggttttggaaacagattcagcttgacaatttcacagcattttgtaagtttttggtttgcactcttctaactggttttaataacttattatcatttataagacctacaaaaacagagtaggttaagccacatcaatctaaytgcctacaagacacgtgccaacatttttacattatatcagtgaccgttctatggcaaacattaagcattcaaataaggaaaatttattagtgtttcacacaagttgaattaagaatctacaaataatatactgacgcactaactttaaaaaaaaagggatgactagaattctgatttcctttggttagctttttgagtaatataactttaacatgttactcataatactaagaaagtgggaaaattgttatgtaagtgtgaaaaaaactttctccaaaatctttcaaagttaaattccta

SEQ ID NO: 81309 - DNA, 601 bp, Human
tatttcaagaaaaatctacatacatcgaataaaaactagttataagaacctaattacttctggatatgtctcataaataagaaatctgaagcacttgtgcaattgattgattgctgcagtatggactcaacaagccacatttttcatggaacatcatttttacttgaaagaacaactgaaaaactatggttaaacttgtgcatctgacctacattttctcgaaaatgagcaaagtgagcctgacacttcaagaaaaactgacagtatttgttgccaatgataaaattcaaactttcaagcraaaatctgaattttggaaaactgcttcccaatacttaaagatacaaaagattaaaaaggaggctttttttggctaaatggtacagggttttggaaacagattcagcttgacaatttcacagcattttgtaagtttttggtttgcactcttctaactggttttaataacttattatcatttataagacctacaaaaacagagtaggttaagccacatcaatctaattgcctacaagacacgtgccaacatttttacattatatcagtgaccgttctatggcaaacattaagcattcaaata

SEQ ID NO: 81310 - DNA, 601 bp, Human
gcggccaagaaaatggactagaaaaagaatgttgcaaacatacaggtctgaggagctcccaatggcgacctaggaaacccaagctctagaaaaatcactcctcacacatgtctcacctcagcctcccctcctacctccacatttctacttaagacaaacatgaaaggcaggcttgaaagggaaaaggagtcacaaaagacagtgtgggtggcggacaggtagaggagcaggtctgcccttttgcaaggtaagccagggtgctgcggagtctaagcacacagtataaacacagcactgagtracagtgtttaagggaatccaagaggtctgtccagtatcccaaacaaagcaccctctccagggtaatcacagctttaagaggcggtcatctaccctcacctcacaatgtgtaaggaaaggagcacttataaggccacttatttcactgattgcaggtcagttagaagactggtctttttttttcctctctctctcttttcaataagcctcaactctgcctcattgtaattaccctcactgctaacttaggctatccaaaaaatttcatcgctcgtctatacagtattccttcaaactgaag

SEQ ID NO: 81311 - DNA, 601 bp, Human
cagaatttgaatgaaaacatcttttaaatattaaatcaccgtgtccttcaggaattaaaaagaaaacacgaaacagattcagagggacaaggggaaaggagaaaagaggaagggaaagaggtggggacagccagcttaggctggcaaaccgcaggctcaggcagtggtgacaaaagccagcttggtccaaggcggccaagaaaatggactagaaaaagaatgttgcaaacatacaggtctgaggagctcccaatggcgacctaggaaacccaagctctagaaaaatcactcctcacacatrtctcacctcagcctcccctcctacctccacatttctacttaagacaaacatgaaaggcaggcttgaaagggaaaaggagtcacaaaagacagtgtgggtggcggacaggtagaggagcaggtctgcccttttgcaaggtaagccagggtgctgcggagtctaagcacacagtataaacacagcactgagtaacagtgtttaagggaatccaagaggtctgtccagtatcccaaacaaagcaccctctccagggtaatcacagctttaagaggcggtcatctaccctcacctcacaatgtg

SEQ ID NO: 81312 - DNA, 601 bp, Human
agtaattctccacacataacatttgtaacaagtaaaacagtagacccttccttccaaatcagtttaacttatattaaatatatcttcttttacatagcttttgaatataccacaattcatttggacataagagtatctgtgtttcatccttaatgaacacataacacaacaatttggtgaagccaaagactttcactaattcaagtaattaaacataaaaacaaagatgcaagcaaaaagccatactacacttctggaggaaaaaaaataaaacattaagatttgaaattactaagtataytttcctaaacattttgctgtgcttcacagccaaaaatataattactgacataaacatcctttaagctaactctcctatttcaactgagaagggggtattgctgtatcttaaaccaaactcagctaaattttgctaaaaccaaaaacaattatgtccacaggcagtctaaccatgaaacatagcaaatcaaactggcctaatacaggatgtaaatgctgaagaaaaacagaattgagtgccacctgaaagtttccagtgggcccaagatatgaggtaaaaatatctcattataactggagt

SEQ ID NO: 81313 - DNA, 601 bp, Human
aaatgaagtaaaatgtgaactatttgaatatgttttataatcacctccaatttacttgtgttttcacaattaaaatacctttcagaattccaacttagtattcatgaaaggaaaatgagcctaaaatgagaatcagagaagggaactgggtaggaaatgaatttcaaagacttccaaagcatattttcaaatcagtaaacaaggcaccttttaattctctacctttggtctcttgattcaaatgaaaataatgtccaatttctcttcctatgagtcaaactgaaaattgcactataattaraagtcataatttctgagcaattaacttaattatcaggaaggcaatacacgtaacaagatttcagtaaaatcatattaacacttgcctcaaatatataaaaacaggccatagtattcaatcaagatatcatgtcatagtaacaaacttcatatagctacttaaatataccactgtaaagatattataaaaatgacttttctagccaaatgctaggaaatgctttgaaattacttccactgagtaacctataatgctatccagtttaataagttttattgatcttaagtaaattacaatgtc

SEQ ID NO: 81314 - DNA, 601 bp, Human
gacagagtctgcaagaattctgtgttcagagccccactttatcaaacaacaaatacaatgatcacatacaggagatctatttcagatcttagctaacaactcaagctttgcagatgcaaatactaaaaactgacaagaaattctttgtaaaaggtgtctttacaatttccactctgcagtttaacaattttaagttatttctggagaatctttgtgtttgaatactgatcaaggttaaacatttttaaatgaaaactgacttttccaatgatcttactaaaaatgttcagggtggaaacaygtttatccacatgtttattgagtgtctgccgtttaccaagcaatgccaaaagttaaggggccatctggcttcctctgtaaagaaccaagatcctgcaaaggcacaaactgtctaaaacatcagaaggacttttccaacaaccagatcattagttcagcctactttaaccctagttgataattcaaaaagtagactctgaacctagtgatatgaaaacactatctaacaaaagataactatcagccttgtcatctgctaatgcactgtgtaattcacttaaaataataactatatagcttt

SEQ ID NO: 81315 - DNA, 601 bp, Human
ccaaccaaaaatgcaggaaaatgttcaatagaagacaagctaacattaacaactccgcctaagtgaagacccaaagttcaactgaaattatctgggtggggcagcatcacatagattactaatgacacctggtttgcagcaccttggattatttaatcctaaagttacatatgaaatttgttgtcagtaatataaacatcttatatttgtgctacaccaaactgtgaaaagaaaacctgccacaaagtactagaactcagcctaaggcaaaaaacttgtacttccaggactgaccctggcytaagaaatgagatgctaagtagaagcattatatgcattattatgtttcctggaaacaactttttaaattatacaacttgtaggtaacaaaactgttaaaaatgatgatcttttttttttttttgagacagggtctcactctgtcatccaggttggagtgcggtagctccaccttggctctccgtaacctccacctcctgggctcaagcgatcctcccacctcagtctcacaagtagctggaactgcaggcacctgccactatgcccacctaattttttgtattttttgtagagacagggt

SEQ ID NO: 81316 - DNA, 601 bp, Human
tacttttgatttttaattgttttctccccttttgtatttaaatttgaaaataaacatgtcatccttgtgcaggggccatgttaatctctgtattgttcccatttttgtatatttgctgccagagcaagcactcccttttatttttataagacttgtcatatttgtgtattccattgcttatacttaaataatctgtcttgaatatctcaattcttttttcctctatttttaaatgtattagttcctgatcttattcttgtatagacttttttctaatttcttaatccatattaattttttmataatgaaagtatctacagcaacaaattcatctttggtaactacaaaaacatggaagaaaagagacgaagagaaaaaagaaaactaaaagaacagccaaccaaaaatgcaggaaaatgttcaatagaagacaagctaacattaacaactccgcctaagtgaagacccaaagttcaactgaaattatctgggtggggcagcatcacatagattactaatgacacctggtttgcagcaccttggattatttaatcctaaagttacatatgaaatttgttgtcagtaatataaacatcttata

SEQ ID NO: 81317 - DNA, 601 bp, Human
gtttgggtcatttctaagagttaattaaacttttacactccctttcaatcacaaatctttctaccaggatggtaaaagcaaataaaatcaaaatcaatgtgtatttttaaagcagctcaatttaattattcacaataagtgcttcaaaaataggacccaaatttcttctgctgggagaaactggtaaattgacaaagctttatcgcaaaaatccctaacttttgagatgtccagactccccagaggcacagaactaagtcagaaactcctttcctggtcccaattctgttagtgctgtgcrtaactttgtacagctccttggatctcagtttcctcgttttcacaaggcaggtgtgcaagtagtgcattcttctttaaagtctctaaacacaaagctaaaaaatcataaactccattcagatgagaggcagaggctcactatcatggcaaaaaccaagaaactgcaagcctcagtgaatgactcaattttaagataagctgtctctgaatacagtaatgacactctccaaagatgaatgctgaatgaaaaaaattaggaatgctgactaattttctaagtgctgctccagtttctcaagat

SEQ ID NO: 81318 - DNA, 601 bp, Human; identical to SEQ ID NO: 31210

SEQ ID NO: 81319 - DNA, 601 bp, Human; identical to SEQ ID NO: 31211

SEQ ID NO: 81320 - DNA, 601 bp, Human
caaaaaggactggcttaatcaggaacattataacatattcaaaaggagactacacattaattgctctcttaagcactgttttaaaagaacttggacataggtaagccgaagtattagtttttaaaactggttgggaacaatatgggtatttgtcattttccccctttgtatttttcttcagcttttcaatcatcccccttcaaaaagcgctttgccaaaaaataaataaataaataaaagttcaaataacatgctgcataatataaacatttgcacccaggtgcacatgacctgctcctgytgcactcaaatcatgtggtttttatgactgtattgtaacacaagtaaacagttaagtcaaaattagatgacgacttacgcatataaggcagcttttctggacaggggaggtatggtgagtatgtgaagttttccgggagatacgttgttgtttgaacaagataatcacttgaattattgccttcgggataatcttggaaagagagaaaagagttacaaaaaaaaaaaaaaggccttttgctttctccctggaatgaaatacgtcactatcactgggagaaaactacaatatacaatctac

SEQ ID NO: 81321 - DNA, 601 bp, Human
aattttcataaccggaaagaatactcagcaaactctcagtagaggtgaggttacttctgaggaaggaatggggagccagcactggggatggtggtcaaaaaggactggcttaatcaggaacattataacatattcaaaaggagactacacattaattgctctcttaagcactgttttaaaagaacttggacataggtaagccgaagtattagtttttaaaactggttgggaacaatatgggtatttgtcattttccccctttgtatttttcttcagcttttcaatcatcccccttcaaaawgcgctttgccaaaaaataaataaataaataaaagttcaaataacatgctgcataatataaacatttgcacccaggtgcacatgacctgctcctgctgcactcaaatcatgtggtttttatgactgtattgtaacacaagtaaacagttaagtcaaaattagatgacgacttacgcatataaggcagcttttctggacaggggaggtatggtgagtatgtgaagttttccgggagatacgttgttgtttgaacaagataatcacttgaattattgccttcgggataatcttggaaagagag

SEQ ID NO: 81322 - DNA, 601 bp, Human
cttgccaccatggccaccacggccaccactaattgggcacaaaattgggacaggacccaaagttggcagcccatgagagggactgctgtgaaaagatggctggccacactagtgtgatcctctcttataaaagaatgcaaggatcccagggaagcagagagaaggggcagtagtgctgagacccctccccacccccagtgaaaaggcagtgcacagcagccacgcacgacgcaatctctcaggcaccacaagagatggtacaatgggctgtggggcgggaggagaggagtaccagaatgakgaagtggcagacagatgctttgaaatagagtttaattagtactcataaagcactaattaaagaaaatggcaactaaaccaagaacagaaagatttcctgaaactataaaccttgaatatgaaaattatgaagatgaaattattgtaatcaatatttcaacagaacattacccagtggtttcagtattacacagacaaaagtattcatttttaggaaaacaaggctgcaataacaaagtaatgacaaccacaaaaatcactgagttccattctttattatggtacagcaaagagacagcaa

SEQ ID NO: 81323 - DNA, 601 bp, Human
cgttatgttggctgtacccatggctcctttctaaagccttatctgtatgtggctgtattttctaccaaatcaccttgccaccatggccaccacggccaccactaattgggcacaaaattgggacaggacccaaagttggcagcccatgagagggactgctgtgaaaagatggctggccacactagtgtgatcctctcttataaaagaatgcaaggatcccagggaagcagagagaaggggcagtagtgctgagacccctccccacccccagtgaaaaggcagtgcacagcagccacgcacracgcaatctctcaggcaccacaagagatggtacaatgggctgtggggcgggaggagaggagtaccagaatgaggaagtggcagacagatgctttgaaatagagtttaattagtactcataaagcactaattaaagaaaatggcaactaaaccaagaacagaaagatttcctgaaactataaaccttgaatatgaaaattatgaagatgaaattattgtaatcaatatttcaacagaacattacccagtggtttcagtattacacagacaaaagtattcatttttaggaaaacaaggctgc

SEQ ID NO: 81324 - DNA, 601 bp, Human
ctggtcgccacatctggccaatggcaccctgtaggttcttttttgtgccttctcctctctccaacgccacagccttggcacttgcccttgttgttgcccgtcggcttcctgcagcaagctcctcattggtctcctgctgatcccagtatttctccattctcacccattgttcagcttctcatgtgaataatcttcctaaaatacaatcctagtccatcattcacctgcctaaagccttcgatggttctccatttccctaaagcagtggtgttttttgtttatttttgctttttttttttttgcccctagaccctttgaaaatcatgcactgtcacctgagagaaatgcatacaggctcataaatcaactgtctgcatgtaagctcacaggctcttctccctctgaagctcacctcatggatgcctaggaatgatggaacccacaaggccctcagattcctcagtcctttacacaagacccttctagccagcttcatttcccatacacgccacttaacacaccctctctgggcagagccgaccactctccagtccgggaatacacagagcctcccttgtggtgatgctgttctctctcagct

SEQ ID NO: 81325 - DNA, 601 bp, Human
cctcccttgtgcttctccctcatccttcccagttctcttctcttcatctttttctttttttgagatggagtctccctctgtttcccaggctgaagtgcagtggcgagatctcagctcactgccagctccacctcctgggttcacgccattctcctgcctcagcctccccagtagctgggacttcaggcgcccgccaccacgcccagctaattttttttatttttggtagagacggggtttcactgtgttagccaggatggtctcgatctcctgacctcattatctgcccgcctcggcctcycaaagtgctgggattacaggcgtgagccacggcgcccggcctcttctctccatcctttctttccatgatgcctacaacatgctcaagtccatctcttcctaaagagctcttcccttacctccacctcctccagatcctttaccccaatctccttccctttgccaccaaacttctctcatttcacctacagtctacatacacttctgacgcacttctcaagagtctactttgcttctctcccaatcattttactgaattcgtgcttgctgtgttctccattcgttttctgcaccaaattca

SEQ ID NO: 81326 - DNA, 601 bp, Human
atggagacctcccttgtgcttctccctcatccttcccagttctcttctcttcatctttttctttttttgagatggagtctccctctgtttcccaggctgaagtgcagtggcgagatctcagctcactgccagctccacctcctgggttcacgccattctcctgcctcagcctccccagtagctgggacttcaggcgcccgccaccacgcccagctaattttttttatttttggtagagacggggtttcactgtgttagccaggatggtctcgatctcctgacctcattatctgcccgcctyggcctctcaaagtgctgggattacaggcgtgagccacggcgcccggcctcttctctccatcctttctttccatgatgcctacaacatgctcaagtccatctcttcctaaagagctcttcccttacctccacctcctccagatcctttaccccaatctccttccctttgccaccaaacttctctcatttcacctacagtctacatacacttctgacgcacttctcaagagtctactttgcttctctcccaatcattttactgaattcgtgcttgctgtgttctccattcgttttctgcacc

SEQ ID NO: 81327 - DNA, 601 bp, Human
tcccctcagggacacacggcctcctgctttactaggaaaacagacacagcaggcacgagcaccctacctctccacctcatctccaaataaaccgcgggcttcctcaggggaggaggcattcctgaggctttccatgctcactcttcaacctgaggcattgtctccattcactttctaacctggctctatggagacctcccttgtgcttctccctcatccttcccagttctcttctcttcatctttttctttttttgagatggagtctccctctgtttcccaggctgaagtgcagtggcgasatctcagctcactgccagctccacctcctgggttcacgccattctcctgcctcagcctccccagtagctgggacttcaggcgcccgccaccacgcccagctaattttttttatttttggtagagacggggtttcactgtgttagccaggatggtctcgatctcctgacctcattatctgcccgcctcggcctctcaaagtgctgggattacaggcgtgagccacggcgcccggcctcttctctccatcctttctttccatgatgcctacaacatgctcaagtccatctcttcctaaagag

SEQ ID NO: 81328 - DNA, 601 bp, Human
tgcagcgacaattatccatgctccaattctttacctaataaacagcactaaagaaagcacgtaagcatatagattaatcccatcatttgggtggcaatacctaacatattgcctcaagcatagtaaggtttcagcaaaaacaagtgtcactttttttttgtattgtgactccaccagggtggggtggggggctctctaggataacctgttagtcaccttctaatttatgattagttgacttcacttttcattccctatgacaactttttaaatacttactcctccctttcaagctgctcartccttcctggccatcccctcagggacacacggcctcctgctttactaggaaaacagacacagcaggcacgagcaccctacctctccacctcatctccaaataaaccgcgggcttcctcaggggaggaggcattcctgaggctttccatgctcactcttcaacctgaggcattgtctccattcactttctaacctggctctatggagacctcccttgtgcttctccctcatccttcccagttctcttctcttcatctttttctttttttgagatggagtctccctctgtttcccaggctga

SEQ ID NO: 81329 - DNA, 601 bp, Human
gacttgaagtcctctctgctatatccacactggcctctgtataaagtggtttgctaattttgatgtgtgcctaagaattaccagctgtgcttgtttaaaatgcagctgactggccacattgtcaaagtttctgtgtcagttgaagctcatgggtcacgtttatggccactggctttaactgaacacatttcaacggcttgaactacccaccattgggtcctgcctttcaaaggaaaaagctagaacccactctccaaacccctctaacaggtaggagtggtcatatgaccaaatgcacccraagtggtggcaaaagcttctagctttacaggaaccaagaagtggcacttctggtctccagacctgagcaatgctggtaggaggtttaagccctgacaagtggcagcaggagatgcttcaaagcggtctgagccttgttctggctgctcaatttctcaacctaattctctagccacccaggttgtctctgggctctctaatatattttcatgaattcttttttctcttaaatcagataaagtatattctgtggtttgcaaccaagaaccctgacttttgcagtctagggtttagctcagag

SEQ ID NO: 81330 - DNA, 601 bp, Human
aatgaatgaatgaatgaatgagtaggaagattcctgtctcatccctgcttccacctacctgcatttctactccctggctccatcaggtgctaaaatatttctttaagacatttatgcaaaactgtgcatacaacaaagtcctaatatccagaatctataaggaatttaaacaattcaacaagcaaaaaacaaccccattaaaaaatgagcaaaaaaaaaaaaaaaatgagcaaaagatactaacttcttaaaaggaaacattcaagtagccaacaaacaaaaaaaaatgctccaaatcacwaatcatcagagaaatgcatattaaaaccacgataagacagcatcaaataccaataggaaaagccattattgaaaagtgaaaaaacaacagatgctggcgaggcttgggaagaaaaggagacgcttatacactgttggtgagaatgtaagttagttcagccactgtggaaagcagtttggagatttctcaaaaaacataaaacagaactaccatttgatccagcaatcctattactgtgtaaatatccaaaagaaaataaatcattctaccaaaaaggcacatgcactattatgttcattg

SEQ ID NO: 81331 - DNA, 601 bp, Human
aaacctgagcattctaaacataagacagagcattagtcacacatccccactgccaagggcaatgcctggacacagaatgaatgaatgaatgaatgagtaggaagattcctgtctcatccctgcttccacctacctgcatttctactccctggctccatcaggtgctaaaatatttctttaagacatttatgcaaaactgtgcatacaacaaagtcctaatatccagaatctataaggaatttaaacaattcaacaagcaaaaaacaaccccattaaaaaatgagcaaaaaaaaaaaaaaaatgagcaaaagatactaacttcttaaaaggaaacattcaagtagccaacaaacaaaaaaaaatgctccaaatcacaaatcatcagagaaatgcatattaaaaccacgataagacagcatcaaataccaataggaaaagccattattgaaaagtgaaaaaacaacagatgctggcgaggcttgggaagaaaaggagacgcttatacactgttggtgagaatgtaagttagttcagccactgtggaaagcagtttggagatttctcaaaaaacataaaacagaactaccatttgatccagcaa

SEQ ID NO: 81332 - DNA, 601 bp, Human
tctattttttggtatctaaaacctaattctggatatgttggcttttgtctgttttaccctcagggttttaaatgttcacagctcaaagagctgatgacagtgtcagagaaagacctgaatttcccctagaaatgtcccttagggtaaattcctctccaaagctagaaaagcatttttatgacaagatgggacattccctcccacactctgtgctgcctcctaagcacagctctgaggctgaacagttatgagtcatccagccattggtcacctcctgtcctttctgaagccaacactagayactgcctatttcaaatgctttacttaagcttctcgacttataaaatttgacaacctctgcttaacaaacgatttattactcaagttttcttgaagcaaccaaacctgagcattctaaacataagacagagcattagtcacacatccccactgccaagggcaatgcctggacacagaatgaatgaatgaatgaatgagtaggaagattcctgtctcatccctgcttccacctacctgcatttctactccctggctccatcaggtgctaaaatatttctttaagacatttatgcaaaactgt

SEQ ID NO: 81333 - DNA, 601 bp, Human
tctttcgcgtactcttttgtcccctttaggtttcactcaagaaagccttccactgctttaaaaacaaaacaaaaggcatcggaaaaccacctgctatgaatgaagctagagagggaatgtccttcttgtaaagaaggacaccatcaactgggccagtcccctttatttcactcgctgagatttcaagggcaactgaagagatccactgaactccatggagagccaatcttcactctcctctgtggtgaatctgagattggttgttgttgttcttaatcccagatgtaatagtataaatctragatttttaactggcacaagtggtttctttcccagttagagatttaaagatcagaaaataaatatgttgactgaaatccatttacccagcagtgtaatcacaatcagcaaatgtaaataatataatttaccaaatactgaatttcactattttgaaggtggcgctggggttagaaaggaaagagcaggagaactgagtgtctgaagagtggaggggctgccaagtacctagaaggtcaaggtgaaggacagggaactcaagtcagctggaagctaccttccagtcgtgtgtgccaaactg

SEQ ID NO: 81334 - DNA, 601 bp, Human
ttcctctctagagagcctctttgctcctgctattctatattttaggagttttcacaatggcctctcttcctgtccccacttcatcctaaccaggcagagctgtctgtagcctccacgcaggcatgctagagtattttacatcgaaatacctgcttcccagaataagttagaaaaagaattgcaatcttctaatgcctgcctgttctactgacaacataagcagtcttttataaccaaacactcagccttcagcgtgacaagatacacaaactagctaatcttagaaaggtcagattcatcwaaaagaaagagaaacctatgaacttgcagagaaagagtaagtaaaatgtaagattgatcagtaaacataagtacagactatcatgactcagctgacaaagaacagaatctaacattgtaatcaaataaaatttacacaaataaatctgatacatttaatagtatgcatgattgctaaaatgatagtaattaggctaaataataagcagttcatataagtaactgaagctggtattctttctgcactgttaaaccacattttttgtcttttttccagctttattgcttcaacagctgtaat

SEQ ID NO: 81335 - DNA, 601 bp, Human
caggccccttggcatacaaaactgaaaaaccacttctgaggtattcctggtctaacaggcactcgttctccaaattaacaaatatatgacattactggaggtgttcttactagtagcttttctaatgtataccattgaaacaggaatgaatcttgaatggaaaaccacttccgttaaccccaaaagagaactaagaatcaagaagcctctttatctccccctgaattaaaatagctgcatgatcactaacatcccttcaaagcaatgctatcttcaatgacttcactgttagaacaggatrtaaaaggctattgaaactacagatcatcttttagcagttttaatgtcatccgttaacttccaaataggtacaaattgctctggagcgccctccagccaaattcttctctctgacctcatctcataaaatacaaaccaacaaatgttgaggtttcccatttcgagtcttctgagtttcatgtggccacaatttcatataaaaacactcagttcctctctagagagcctctttgctcctgctattctatattttaggagttttcacaatggcctctcttcctgtccccacttcatcctaacc

SEQ ID NO: 81336 - DNA, 601 bp, Human; identical to SEQ ID NO: 31212

SEQ ID NO: 81337 - DNA, 601 bp, Human; identical to SEQ ID NO: 31213

SEQ ID NO: 81338 - DNA, 601 bp, Human; identical to SEQ ID NO: 31214

SEQ ID NO: 81339 - DNA, 601 bp, Human; identical to SEQ ID NO: 31215

SEQ ID NO: 81340 - DNA, 601 bp, Human; identical to SEQ ID NO: 31216

SEQ ID NO: 81341 - DNA, 601 bp, Human; identical to SEQ ID NO: 31217

SEQ ID NO: 81342 - DNA, 601 bp, Human; identical to SEQ ID NO: 31218

SEQ ID NO: 81343 - DNA, 601 bp, Human; identical to SEQ ID NO: 31219

SEQ ID NO: 81344 - DNA, 601 bp, Human; identical to SEQ ID NO: 31220

SEQ ID NO: 81345 - DNA, 601 bp, Human; identical to SEQ ID NO: 31221

SEQ ID NO: 81346 - DNA, 601 bp, Human; identical to SEQ ID NO: 31222

SEQ ID NO: 81347 - DNA, 601 bp, Human; identical to SEQ ID NO: 31223

SEQ ID NO: 81348 - DNA, 601 bp, Human; identical to SEQ ID NO: 31224

SEQ ID NO: 81349 - DNA, 601 bp, Human; identical to SEQ ID NO: 31225

SEQ ID NO: 81350 - DNA, 601 bp, Human; identical to SEQ ID NO: 31226

SEQ ID NO: 81351 - DNA, 601 bp, Human; identical to SEQ ID NO: 31227

SEQ ID NO: 81352 - DNA, 601 bp, Human; identical to SEQ ID NO: 31228

SEQ ID NO: 81353 - DNA, 601 bp, Human; identical to SEQ ID NO: 31229

SEQ ID NO: 81354 - DNA, 601 bp, Human; identical to SEQ ID NO: 31230

SEQ ID NO: 81355 - DNA, 601 bp, Human; identical to SEQ ID NO: 31231

SEQ ID NO: 81356 - DNA, 601 bp, Human; identical to SEQ ID NO: 31232

SEQ ID NO: 81357 - DNA, 601 bp, Human; identical to SEQ ID NO: 31233

SEQ ID NO: 81358 - DNA, 601 bp, Human
tcatcattgttgttgaacattcactttatagatatttaattttttgtttaaaatttgtgaaaatatcaagatattttaaacaatctttataattgctaattttcaaaaaagaatactgttcggctttactgtggaaaaattcatccaaaattaagatatgtacttgatatcaggtagtaagaccttttttcagagaacagtcatatgaagataactggacaaagccctgacactcatgcaaacatgtaagatattacatatagaagacattatggcatcagtgcaccaaataactcatcaygtattttaagacaatgctattaaattatgcttttagatactacatatagaagacattataatatcagcgcactgaatactgatcatgtattttaagataattctattaaattatacttttagaaagaaaattttagtaattaacaccagagatataatctcttaaaagtgaaaaaaacaaaatatagtttgaatgaaactaacattcaagggtcccctccaaaagtgaaattctatgtctgaaaactaaacttaaaatttgtttttatctactaagtatttatctttataaaaatagaat

SEQ ID NO: 81359 - DNA, 601 bp, Human
cacttcaaaataaaacttacaatctgagataaataaccatagttctgttttaggtaaacaatccttgaggcaaatattatccaaacgtttctcatatatagatttctattgctcatcattgttgttgaacattcactttatagatatttaattttttgtttaaaatttgtgaaaatatcaagatattttaaacaatctttataattgctaattttcaaaaaagaatactgttcggctttactgtggaaaaattcatccaaaattaagatatgtacttgatatcaggtagtaagaccttttytcagagaacagtcatatgaagataactggacaaagccctgacactcatgcaaacatgtaagatattacatatagaagacattatggcatcagtgcaccaaataactcatcatgtattttaagacaatgctattaaattatgcttttagatactacatatagaagacattataatatcagcgcactgaatactgatcatgtattttaagataattctattaaattatacttttagaaagaaaattttagtaattaacaccagagatataatctcttaaaagtgaaaaaaacaaaatatagt

SEQ ID NO: 81360 - DNA, 601 bp, Human
ctgtttataggcaaaaataattttaggtctacactaaaaaagcaaaacaaacaaacaaaaagcaaacgaggtggttttcacaggatgacaaactatatttcaaaactgaaaaaaagcaaaatgtttatatctcactcctgaaacaaaaattaacatcagacttaagaaaataaggcagatactagtagtactaagttttcttgaaactgtaaaatatatataaaaatgaaaagataccgaatgtggacagctccacattgatcaacaaatgttaacattctcaatctctttcattgacttkaaaaactatgtaatagaaacagaaaatgaactaatacacaaatgaagtacaaatatcataattttcagaaggtttgatttttcgagtaccataaaaaaactgaaatataaatattttggaaatagttctaagaaataaatatgaaaatattttgtttggtatcataacacagaagctatccattttctcaaagtgtaaggattcaattattttatgatttagtttgtggtcatttgtgttatcaatattgccataaaaatgacacttcaaaataaaacttacaatctgagataaataacc

SEQ ID NO: 81361 - DNA, 601 bp, Human
tgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaamaaggcagcggctccttggtaaagctactccttgatcgatcctttgcaccggattgttcaaagtggaccccaggggagaagtcggagcaaagaacttaccaccaagcaggtatggtttttctttctttctcttttgctgggggctgaccgcccttcagctccagccaaaagatgtgtgtgaacacaaatataccttctgtttgaggtcagcatcatagtgggtcgtgaatcatgttggccttgctgctgtctcctcatttctagggtggaaaaaaaaaagcatgaaaacaatcacttaatg

SEQ ID NO: 81362 - DNA, 601 bp, Human
ggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttc

SEQ ID NO: 81363 - DNA, 601 bp, Human
agggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaacyttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtcta

SEQ ID NO: 81364 - DNA, 601 bp, Human
agttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacrgagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaa

SEQ ID NO: 81365 - DNA, 601 bp, Human
ttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttsacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaac

SEQ ID NO: 81366 - DNA, 601 bp, Human; identical to SEQ ID NO: 31348

SEQ ID NO: 81367 - DNA, 601 bp, Human; identical to SEQ ID NO: 31349

SEQ ID NO: 81368 - DNA, 601 bp, Human; identical to SEQ ID NO: 31350

SEQ ID NO: 81369 - DNA, 601 bp, Human; identical to SEQ ID NO: 31351

SEQ ID NO: 81370 - DNA, 601 bp, Human; identical to SEQ ID NO: 31352

SEQ ID NO: 81371 - DNA, 601 bp, Human; identical to SEQ ID NO: 31353

SEQ ID NO: 81372 - DNA, 601 bp, Human
tagccaggcgttgtggcaggcacctgtaatcccagctactcgggaggttgaggcaggagaattgcttgaacctgggaggcggaggttgcagtgagccgagatcgtgctattgcactccagcctgggtgacagagccagactccgtctcaaaaaaaaaaaaaaaaaaagggctccgcacccaggtcagacagttcatgaaggtgataatatatagagaacacacacctcagactcacagcctttctccactgcaagcgtaagagactggttttatttcaagaataactaagggtatattaayacatgtatctcaaagtaacattgaattattgaagacatactgttccaatactcaaacagttcacagagaggggacaggaaccaatgtactggaaaaacacacttgtattatatgtaaaaatcgatggccaatatttctcttattaagagaaaaatacccaacaaattaaaaggtgaaaagctgtgctcaaaaaaaaaataaaaaaacccaaaaccttgcatgcacaagctaagctcagacccttaaaaaccagatagaaattgacaaagtcaaacaaaggagaaaaactagctgaacttc

SEQ ID NO: 81373 - DNA, 601 bp, Human
tcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggckggtctgcgaagtacatcgattatgccggcagtctagtcggttaataaagcccaggagttgcagcgttacggatcggtgctttgagaggccaggttgccgcgcaatggattgtgcaaatgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaat

SEQ ID NO: 81374 - DNA, 601 bp, Human
acctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaaygtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagtt

SEQ ID NO: 81375 - DNA, 601 bp, Human
tctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatatkctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtg

SEQ ID NO: 81376 - DNA, 601 bp, Human
tttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttamattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgaga

SEQ ID NO: 81377 - DNA, 601 bp, Human
aggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggctgggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgtt

SEQ ID NO: 81378 - DNA, 601 bp, Human
gcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggcygggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctg

SEQ ID NO: 81379 - DNA, 601 bp, Human
accagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggctgggcgcggtggctcacacctgtaatcccagcactctgggaggccgaggcgggcagatcacgaggtcaggagatcragaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggc

SEQ ID NO: 81380 - DNA, 601 bp, Human
actgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcktagagatgagatctccctgtattgcccaaggtggtctctaactcctgggctcaagcaggcctcctgtcccagcctcccaaagcactggaattacaggtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacatttt

SEQ ID NO: 81381 - DNA, 601 bp, Human
tgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcgtagagatgagatctccctgtattgcccaaggtggtctctaactcctgggctcaagcaggcctcctgtcccagcctcccaaagcactggaattacargtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacataggacagccttccacagcaaagaattacccggcctaaaatgtcagtagtgccagcgttgagaaaccctggtatgtacttagcccccc

SEQ ID NO: 81382 - DNA, 601 bp, Human
tggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgcttttttttttttttaattgagatggagtcttgctctgtcgcccaggttggagtgcagtggtgcaatctcrgctcactgccaacctctgccgcccgggttcaagcgattgtcgtgcgcagcctcccgagtagctgggattacaggctcccgccaccatgcctggctattttttttttttttttttttttttttttagtagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatag

SEQ ID NO: 81383 - DNA, 601 bp, Human
tttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctcygcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggct

SEQ ID NO: 81384 - DNA, 601 bp, Human
ctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactrtttgattgcaaagaggattgttctgcattttattactttttttttttttttgagacagagtttcactcttgttgccaggctggagtgcaatctcgtgaccttggctcactgcaacctccgcctgccagcctaagtagctgggattacaggcacacaccaccatgcccagctaattttttgtatttttagtagggatggggtttcaccatgttagccaggctggtctcaaactcctcaccttgggtgatccgcctgccttggcctcccaaagtgctgggattacaggcttgagccactgcg

SEQ ID NO: 81385 - DNA, 601 bp, Human
tctgctttctctgcttgttttcagtgtccctgccctcagttgtgccctgtgtccccaagcccagagactttccattttgccctttctaaagaacctccagttttttgcctgagtgggagaggagacccagggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtrttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttg

SEQ ID NO: 81386 - DNA, 601 bp, Human
gctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacarcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctg

SEQ ID NO: 81387 - DNA, 601 bp, Human
tgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccrttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttag

SEQ ID NO: 81388 - DNA, 601 bp, Human
taacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaacatttttttagc

SEQ ID NO: 81389 - DNA, 601 bp, Human
ttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaasatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctcc

SEQ ID NO: 81390 - DNA, 601 bp, Human
tgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaatttttwacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggt

SEQ ID NO: 81391 - DNA, 601 bp, Human
taaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcrggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaagaaaggaatttggaggtatgcagcgtctagctttggatcagcagttcagtaatat

SEQ ID NO: 81392 - DNA, 601 bp, Human
ggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaargaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttcaa

SEQ ID NO: 81393 - DNA, 601 bp, Human
cactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaagaaaggaatttggaggtatgcagcgtctagctttgratcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttcaagcgattctcatgcctcagtcttctgagtagctggga

SEQ ID NO: 81394 - DNA, 601 bp, Human
cggagcttgcagtgaatcgagatggcgccactgcactccagcctggggcaacagagtgagactccatctcaaaaaaaaaaaaagaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctcccc

SEQ ID NO: 81395 - DNA, 601 bp, Human
caggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaaagttatcaaagaattatataacattttgtgtgtgtgtgtgtgtgtgtgtgtgtgtgtgtgtgtgtgtgtgtgtgcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaa

SEQ ID NO: 81396 - DNA, 601 bp, Human
actggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccacygcactccagctgacagagtgagactccatctcaaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgtt

SEQ ID NO: 81397 - DNA, 601 bp, Human
aggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggacygctttatgcgctgctttttaccacaccttaaatagtgcctggttgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctgttctaagatataaggaataataaattcctgttactgttttcatgaaacttaaatt

SEQ ID NO: 81398 - DNA, 601 bp, Human
gtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtascagttttgtaccaactgctgttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaa

SEQ ID NO: 81399 - DNA, 601 bp, Human
ttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctrttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcattt

SEQ ID NO: 81400 - DNA, 601 bp, Human
tcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcrctccgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttct

SEQ ID NO: 81401 - DNA, 601 bp, Human
tgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctccgtcacccaggctggagtgcagtggcatgatctcagctcactgcaaactctgcctcccgggttcacaccattctcctgcctcagcctcccgagtagctggcagtacaggtgcccrccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccat

SEQ ID NO: 81402 - DNA, 601 bp, Human
ttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcayttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctatctccagtctgtaggggaagatgacagaacttaacacagtgcttggaacctgttaggtacttaataaatatttgctaaatgaatgcaataatact

SEQ ID NO: 81403 - DNA, 601 bp, Human
tctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctrtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtt

SEQ ID NO: 81404 - DNA, 601 bp, Human
agtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcartctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattca

SEQ ID NO: 81405 - DNA, 601 bp, Human
aatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagaraaaaccagaagttgctttttcccttttcactacttagatttatgatctttttatatatttttgtcattcataatttctttttgaggcaagttccctggccacccgcagtagctcatgcctgtattcatagcgctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttcttttttt

SEQ ID NO: 81406 - DNA, 601 bp, Human
agggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagaaaaaaccagaagttgctttttcccttttcactacttagatttatgatctttttatatatttttgtcattcataatttctttttgaggcaagttccctggccacccgcagtagctcatgcctgtattcatagygctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagt

SEQ ID NO: 81407 - DNA, 601 bp, Human
tttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacraggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccgggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattc

SEQ ID NO: 81408 - DNA, 601 bp, Human
ttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacaaggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccrggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatat

SEQ ID NO: 81409 - DNA, 601 bp, Human
tttctccagtctgtttatttggtcctatacccataccgtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagakgggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaa

SEQ ID NO: 81410 - DNA, 601 bp, Human
tagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggmcccaacttttttaagctctttcttctgttactccaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttcta

SEQ ID NO: 81411 - DNA, 601 bp, Human
gttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggccccaacttttttaagctctttcttctgttactcyaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacaca

SEQ ID NO: 81412 - DNA, 601 bp, Human
atggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatygcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccagg

SEQ ID NO: 81413 - DNA, 601 bp, Human
tggtgagccgagatcgcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtwatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccagggagtgatcacaatgaaattagtgatataattaggaactaagaacttgaggaggaagactgaccctatgaaggtgtggggtcagtgaattacagatcctggta

SEQ ID NO: 81414 - DNA, 601 bp, Human
aattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgraaggacaaaggagcattgttatacaacaccccagggagtgatcacaatgaaattagtgatataattaggaactaagaacttgaggaggaagactgaccctatgaaggtgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttt

SEQ ID NO: 81415 - DNA, 601 bp, Human
agcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccagggagtgatcacaatgaaattagtgatataattaggaactaagaacttgaggaggaagactgaccctatgaagktgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatataga

SEQ ID NO: 81416 - DNA, 601 bp, Human
ttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcmcttgaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttac

SEQ ID NO: 81417 - DNA, 601 bp, Human
tgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcacttgaggtcaggagtttgagaccagcctggtcaacatggtgaaaccctgcctctaytaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccc

SEQ ID NO: 81418 - DNA, 601 bp, Human
aataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttmagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtc

SEQ ID NO: 81419 - DNA, 601 bp, Human
agtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagtctggagtgcagtggtgcaatcttggctcactgcagctctctacctcctgggcccaagcaatccttccacctcagcctcctgagtagctgggaccagaggtgtgtactaccacatccggctgattttttgtattttctacagagacraagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttc

SEQ ID NO: 81420 - DNA, 601 bp, Human
ttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccrtttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtcca

SEQ ID NO: 81421 - DNA, 601 bp, Human
catcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattarctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccggcctgggtaacataaggagacctca

SEQ ID NO: 81422 - DNA, 601 bp, Human
ctctactaaaaaaatacaaaaattagctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccrgcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaacaaaagaatctttagaataggaggaggatattgagcagaaccataagaaactagtgattaagagtccaggtgtgaaaatagaaaccacgtctc

SEQ ID NO: 81423 - DNA, 601 bp, Human
ctgggattacaggcccatgccaccatgcccagctaattttttgtatttttagtagagatggggtttcaccatgttggccaggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccrcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctgtttcagtag

SEQ ID NO: 81424 - DNA, 601 bp, Human
attgaatgtagaagcttgtatgaaaatttcatacaaatatattatttgtgttataatgtgcttattgttattttgaaatcaattgttaaatacttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgwgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggc

SEQ ID NO: 81425 - DNA, 601 bp, Human
gtaaaagggaccaaaaagtgtgagaatgtttgatgtagagaaactccaagctcattccctggactttggctatagatgctttcttcaggggtgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttaygtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaa

SEQ ID NO: 81426 - DNA, 601 bp, Human
tctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacgtttattagtttgaagccccaattttctttttttttttttcttttaagtgaaaacaagtttataaaagaa

SEQ ID NO: 81427 - DNA, 601 bp, Human
gaccctgctgttgccgctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactytccccttgtctataagtaacttaaatataaaatgttataacaatacgtttattagtttgaagccccaattttctttttttttttttcttttaagtgaaaacaagtttataaaagaagtaaagaaacaggccaggcgctgtggctcacacgtgtaatcctagcactttgggaggccgaggcaggtggatcacctggggtcaggagttcgagaccagcctggccaacatggtgaaaccccatctctactaaaaatacaaaattagccagtcgtggtggtgcgcacctgtaatcccagctact

SEQ ID NO: 81428 - DNA, 601 bp, Human
gcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttrtaacaatacgtttattagtttgaagccccaattttctttttttttttttcttttaagtgaaaacaagtttataaaagaagtaaagaaacaggccaggcgctgtggctcacacgtgtaatcctagcactttgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttggg

SEQ ID NO: 81429 - DNA, 601 bp, Human
tggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacrtttattagtttgaagccccaattttctttttttttttttcttttaagtgaaaacaagtttataaaagaagtaaagaaacaggccaggcgctgtggctcacacgtgtaatcctagcactttgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggt

SEQ ID NO: 81430 - DNA, 601 bp, Human
ctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttytattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaa

SEQ ID NO: 81431 - DNA, 601 bp, Human
tcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagyagtgctctatatacatttctaatgtattcctcatggttatttatatcctggtaattttgaagccctgtccctgttttgtgtttgggaggtggggagggagatagactttctctgcactaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacat

SEQ ID NO: 81432 - DNA, 601 bp, Human
attcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgttyccccccccccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctgacccagtagtaaagcattttttgagtaagatttaaccaccattcttaaatctagactgagtaggacagaaagggaaatccctgtgttt

SEQ ID NO: 81433 - DNA, 601 bp, Human
tgcagagtaaatcccctcagcctccttgggtactcccacaggagtttcgctgaacagaagcctactttattccatacttggaattgtttccccccccccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctsacccagtagtaaagcattttttgagtaagatttaaccaccattcttaaatctagactgagtaggacagaaagggaaatccctgtgtttttaaattttaatgagatttacagaggaagaaaaaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtaaaatagggcaacactacattc

SEQ ID NO: 81434 - DNA, 601 bp, Human
ctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgsgcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttctttttttttttttttgagacagagtcttgccctgtgacccaggc

SEQ ID NO: 81435 - DNA, 601 bp, Human
cctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactrccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaact

SEQ ID NO: 81436 - DNA, 601 bp, Human
ttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtcygctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgc

SEQ ID NO: 81437 - DNA, 601 bp, Human
atgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaartgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctgg

SEQ ID NO: 81438 - DNA, 601 bp, Human
tcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcmttgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactagaagaattcagaatctagttcagtcaggaataatcttatcag

SEQ ID NO: 81439 - DNA, 601 bp, Human
agaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactrgaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatct

SEQ ID NO: 81440 - DNA, 601 bp, Human
ctcactgcagcctggaattcctgggctcaagtatctttccacctcagcctcctgaggtagctgggactataggcgcgcaccaccacacccaactaaagtaacctattttatttatttatgagacggagcctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcacygtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactctttt

SEQ ID NO: 81441 - DNA, 601 bp, Human
gttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaatcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccc

SEQ ID NO: 81442 - DNA, 601 bp, Human
tttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcartcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaaccc

SEQ ID NO: 81443 - DNA, 601 bp, Human
acctctgcctcccaagttcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttcctyttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttt

SEQ ID NO: 81444 - DNA, 601 bp, Human
ttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaaraaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacatttatcagtctttttt

SEQ ID NO: 81445 - DNA, 601 bp, Human
ctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacrcacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgcggtggctca

SEQ ID NO: 81446 - DNA, 601 bp, Human
tgtctaaacacacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgyggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaaataacagcacttcc

SEQ ID NO: 81447 - DNA, 601 bp, Human
ggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcaatacataacatttgaataagccagactaacatctttctaggctatagttctaatgtagagcaataaaaatagaaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaag

SEQ ID NO: 81448 - DNA, 601 bp, Human
tacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaaggagtcagtaaagctaaaggcagaaaataatgaatttgaaaacagtagaaatggtaaatccaaaactttggtgggtgtccccccccctcccaccgacaaggaagtgagaaragaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtga

SEQ ID NO: 81449 - DNA, 601 bp, Human
aaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcrggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagat

SEQ ID NO: 81450 - DNA, 601 bp, Human
ccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaacttwaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtc

SEQ ID NO: 81451 - DNA, 601 bp, Human
aagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaactt

SEQ ID NO: 81452 - DNA, 601 bp, Human
tctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgwcaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggaga

SEQ ID NO: 81453 - DNA, 601 bp, Human
ctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgayaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagac

SEQ ID NO: 81454 - DNA, 601 bp, Human
aagtttaatcacagaaattattcctacgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtac

SEQ ID NO: 81455 - DNA, 601 bp, Human; identical to SEQ ID NO: 24821

SEQ ID NO: 81456 - DNA, 601 bp, Human; identical to SEQ ID NO: 24822

SEQ ID NO: 81457 - DNA, 601 bp, Human; identical to SEQ ID NO: 24823

SEQ ID NO: 81458 - DNA, 601 bp, Human; identical to SEQ ID NO: 24824

SEQ ID NO: 81459 - DNA, 601 bp, Human; identical to SEQ ID NO: 24825

SEQ ID NO: 81460 - DNA, 601 bp, Human; identical to SEQ ID NO: 24826

SEQ ID NO: 81461 - DNA, 601 bp, Human; identical to SEQ ID NO: 24827

SEQ ID NO: 81462 - DNA, 601 bp, Human; identical to SEQ ID NO: 24828

SEQ ID NO: 81463 - DNA, 601 bp, Human; identical to SEQ ID NO: 24829

SEQ ID NO: 81464 - DNA, 601 bp, Human; identical to SEQ ID NO: 24830

SEQ ID NO: 81465 - DNA, 601 bp, Human; identical to SEQ ID NO: 24831

SEQ ID NO: 81466 - DNA, 601 bp, Human; identical to SEQ ID NO: 24832

SEQ ID NO: 81467 - DNA, 601 bp, Human; identical to SEQ ID NO: 24833

SEQ ID NO: 81468 - DNA, 601 bp, Human; identical to SEQ ID NO: 24834

SEQ ID NO: 81469 - DNA, 601 bp, Human; identical to SEQ ID NO: 24835

SEQ ID NO: 81470 - DNA, 601 bp, Human; identical to SEQ ID NO: 24836

SEQ ID NO: 81471 - DNA, 601 bp, Human; identical to SEQ ID NO: 24837

SEQ ID NO: 81472 - DNA, 601 bp, Human; identical to SEQ ID NO: 24838

SEQ ID NO: 81473 - DNA, 601 bp, Human; identical to SEQ ID NO: 24839

SEQ ID NO: 81474 - DNA, 601 bp, Human; identical to SEQ ID NO: 24840

SEQ ID NO: 81475 - DNA, 601 bp, Human; identical to SEQ ID NO: 24841

SEQ ID NO: 81476 - DNA, 601 bp, Human; identical to SEQ ID NO: 24842

SEQ ID NO: 81477 - DNA, 601 bp, Human; identical to SEQ ID NO: 24843

SEQ ID NO: 81478 - DNA, 601 bp, Human; identical to SEQ ID NO: 24844

SEQ ID NO: 81479 - DNA, 601 bp, Human; identical to SEQ ID NO: 24845

SEQ ID NO: 81480 - DNA, 601 bp, Human; identical to SEQ ID NO: 24846

SEQ ID NO: 81481 - DNA, 601 bp, Human; identical to SEQ ID NO: 24847

SEQ ID NO: 81482 - DNA, 601 bp, Human; identical to SEQ ID NO: 24848

SEQ ID NO: 81483 - DNA, 601 bp, Human; identical to SEQ ID NO: 24849

SEQ ID NO: 81484 - DNA, 601 bp, Human; identical to SEQ ID NO: 24850

SEQ ID NO: 81485 - DNA, 601 bp, Human; identical to SEQ ID NO: 24851

SEQ ID NO: 81486 - DNA, 601 bp, Human; identical to SEQ ID NO: 24852

SEQ ID NO: 81487 - DNA, 601 bp, Human; identical to SEQ ID NO: 24853

SEQ ID NO: 81488 - DNA, 601 bp, Human; identical to SEQ ID NO: 24854

SEQ ID NO: 81489 - DNA, 601 bp, Human; identical to SEQ ID NO: 24855

SEQ ID NO: 81490 - DNA, 601 bp, Human; identical to SEQ ID NO: 24856

SEQ ID NO: 81491 - DNA, 601 bp, Human
ttctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaartagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcaga

SEQ ID NO: 81492 - DNA, 601 bp, Human
aaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaaytattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgt

SEQ ID NO: 81493 - DNA, 601 bp, Human
ttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttcygagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgc

SEQ ID NO: 81494 - DNA, 601 bp, Human
taggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaaytaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcat

SEQ ID NO: 81495 - DNA, 601 bp, Human
tgaggccaagagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtmaaattccatctctaccaaaaatacaaaaaaattagctgggtgccaggcacagtgcctcacacctataatcccagcactttgggaggccgaggcaagtggatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctgga

SEQ ID NO: 81496 - DNA, 601 bp, Human
acaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtgsatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaatta

SEQ ID NO: 81497 - DNA, 601 bp, Human
ttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtggatcacctggggtcgggagttcaagaccagcctggccaacatggtgaaaccccatctctactaaaaatayaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactat

SEQ ID NO: 81498 - DNA, 601 bp, Human
gatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtggatcacctggggtcgggagttcaagaccagcctggccaacatggtgaaaccccatctctactaaaaatacaaaaattagctaggtgtggtggtacatgccggtastcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactatcatttttaacacttttctggggggaaatattattc

SEQ ID NO: 81499 - DNA, 601 bp, Human
gccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttwtgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatg

SEQ ID NO: 81500 - DNA, 601 bp, Human
taaaaaaatgtaatgctgctactgttttgcttatgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgytgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagagatgggtttttgcca

SEQ ID NO: 81501 - DNA, 601 bp, Human
tgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcrgagcttgcagtgagcagagatcacactgcactccagcctgggcgacagagtgagactccgtctcaaaaaaaaaaaaataaataacacttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgt

SEQ ID NO: 81502 - DNA, 601 bp, Human
acatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacacttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcagg

SEQ ID NO: 81503 - DNA, 601 bp, Human
agccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacayttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctcctt

SEQ ID NO: 81504 - DNA, 601 bp, Human
agaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctrtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgccttatgttggggctatcagaattccagttgctaattgattaatctgctctgttaggagaacgtttgttgaatacctgccctgccaggctttctgcttacactggtggggggcacattgacaag

SEQ ID NO: 81505 - DNA, 601 bp, Human
tttgggaggctgaggcagaaggatcagttgaacccaggagttcaagaccagcctagccatcatagtgagacaccatctctacaaaaaatttaaaaattagccaggcatagtggcacactcctgtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgcyttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatggagatgacgacatctggttcatttttgaagagtgaatagaaagatcccagcc

SEQ ID NO: 81506 - DNA, 601 bp, Human
catggagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacargatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaa

SEQ ID NO: 81507 - DNA, 601 bp, Human
gggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttaytaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagagga

SEQ ID NO: 81508 - DNA, 601 bp, Human
tcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttactaattcatttaaaatacatcagtgcgggccgggtgtggtggctcacacttataatcccaacactttggaaggccaaggcgggaggatcacttgaagccacaaatttaagaccagcctggrtaatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcaactataggttagcagttgct

SEQ ID NO: 81509 - DNA, 601 bp, Human
tttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcaygcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaagactagcattgattttattacatgt

SEQ ID NO: 81510 - DNA, 601 bp, Human
ggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattataggaggaaaagttaagaaaarcacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagta

SEQ ID NO: 81511 - DNA, 601 bp, Human
atcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacraaaatatatcttaaagacttttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactgga

SEQ ID NO: 81512 - DNA, 601 bp, Human
acataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacgaaaatatatcttaaagacttttaatcattttcaactaaaatattttggataatactgccttatatttaggyagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaac

SEQ ID NO: 81513 - DNA, 601 bp, Human
tagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttattacataaaagtaaaattcatactgttgtcttgacacttagtttttattcattttgagatctaagactgaaaagtctrcttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagt

SEQ ID NO: 81514 - DNA, 601 bp, Human
gaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagaccagactggccaacatggcaaaaccctatctctactgaaaatatagaaattaactgggcatggtggcgcrcgcctgtgattccagctactcaggagactgaggcacaagaattgcttcaacccgggaggcataggttgcattgagctgagattgcaccactgcactgtgacagagtgagactctgtctttaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagaga

SEQ ID NO: 81515 - DNA, 601 bp, Human
tagaaagtgtatctggccattgcagtggctcatgcctgtaatcccaacactctgggaggccgaggtgggctgatcacttgaggccaggagttcgagaccagactggccaacatggcaaaaccctatctctactgaaaatatagaaattaactgggcatggtggcgcgcgcctgtgattccagctactcaggagactgaggcacaagaattgcttcaacccgggaggcataggttgcattgagctgagattgcaccactgcactgtgacagagtgagactctgtctttaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatc

SEQ ID NO: 81516 - DNA, 601 bp, Human
aaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcragttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttc

SEQ ID NO: 81517 - DNA, 601 bp, Human
ctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgrggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgcc

SEQ ID NO: 81518 - DNA, 601 bp, Human
tcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgytctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagca

SEQ ID NO: 81519 - DNA, 601 bp, Human
ccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctgrccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtc

SEQ ID NO: 81520 - DNA, 601 bp, Human
gccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatsccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagc

SEQ ID NO: 81521 - DNA, 601 bp, Human
tcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatcccacagacacatcctgtactttcctacctcccctttggctgtgatcccctctactcaaaacaaacactcttccctatcttcattgcattttgttgaaatcccatggctsttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttg

SEQ ID NO: 81522 - DNA, 601 bp, Human; identical to SEQ ID NO: 24857

SEQ ID NO: 81523 - DNA, 601 bp, Human
ctgcccttccccctcccccctgggaaaggagaggcaccactcagacgcaggcaggccaaaaccctagtttatttcagcatcagcagtatcttagccatcaaaaaaataaactctaccaagggtgacggaagtctctacagcaaggctaagggctcgccagacggcgaacatcaggggtgcatggtgggcactgcccaggcaataagttaggaagcagcagggctggtgtcgggtgtgggccgggcttcatttctgggcaggcatgaggtcgtcgatggcctggccctgctccagccgctgytccatctcgatgagcagcttcactccgtccaccaccatctgcaccagctccacctctgagaagcccaggcggtcagcgttggagacgtcgaagaccccgcccaccgcagccgtgtccacaccgcctggggagacagcaagtcagggcggaggaaacagggctgcccaaaggccacgggaagccgcagcacctgccctgctcacctgtgcctcgcttctgaagtcgcagccgcttaagcacctccgagaacttctcatgcttgcccaggttgggcagcttgatatgcacacctgcccgcag

SEQ ID NO: 81524 - DNA, 601 bp, Human
tgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcacygggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagcgacgacctcctcccgtgtcccatcacccttgacagctgattaggcgcctcatcttccactgtcccccgggcggcctgatctggcaggtcagttgaa

SEQ ID NO: 81525 - DNA, 601 bp, Human
aagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcrtcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggcccggcgtggagaacagactacaggagcagcaggctgagg

SEQ ID NO: 81526 - DNA, 601 bp, Human
tacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacccctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcct

SEQ ID NO: 81527 - DNA, 601 bp, Human
ccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaakactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctggga

SEQ ID NO: 81528 - DNA, 601 bp, Human
gggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaagaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaa

SEQ ID NO: 81529 - DNA, 601 bp, Human
gaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatkcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccatt

SEQ ID NO: 81530 - DNA, 601 bp, Human
agaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcaygcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccat

SEQ ID NO: 81531 - DNA, 601 bp, Human
aacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagygcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattaca

SEQ ID NO: 81532 - DNA, 601 bp, Human
ccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggyaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggc

SEQ ID NO: 81533 - DNA, 601 bp, Human
aggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcagaggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttycccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagat

SEQ ID NO: 81534 - DNA, 601 bp, Human
tccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggcygtcttcccctcagaggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattca

SEQ ID NO: 81535 - DNA, 601 bp, Human
gtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgygtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggag

SEQ ID NO: 81536 - DNA, 601 bp, Human
gggggaaggctggcgggcacggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactg

SEQ ID NO: 81537 - DNA, 601 bp, Human
gagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccracctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttat

SEQ ID NO: 81538 - DNA, 601 bp, Human
ggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccayggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagt

SEQ ID NO: 81539 - DNA, 601 bp, Human
gggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgrcacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccatggcctgca

SEQ ID NO: 81540 - DNA, 601 bp, Human
actcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggyctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcag

SEQ ID NO: 81541 - DNA, 601 bp, Human
ctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagcygtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgag

SEQ ID NO: 81542 - DNA, 601 bp, Human
gtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggartaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctg

SEQ ID NO: 81543 - DNA, 601 bp, Human
tttttgtatttttagtaaagacagggtttcaccatgttggctacgctggtctcgcattcctgacctcatgatctacctgcctcgatctcccaaagtgctgggattataggcgtgaaccacccaccgcacctggcctgaaagccattctttaacacaatatttaacaaaaatattctatcacttagacatttcacaaattcagacggaaacactattccccatatctccctgccaaaatgattgtaaaacgcacggaggctccaaccctcttgttctaaatacattttgggactttggtccrttatacgttttcagtttagaaaatggatcagctatggctctttacgtttctttccttttttttttttttccttttttgagatgaggtctcgctatgttgaccaggctggtctcgacctcctggcctcaagcaatcctcccatctcagcctcccagtgctaggattacaagcatgaatcactacgacctgcccgtctttaagtttctagatctgtttttcctaaattatggtaataactgagtcatcctggtgcagaatctgataagatgttgctttggagtgtgatacaaacccctggga

SEQ ID NO: 81544 - DNA, 601 bp, Human
atgacattggaattttaagatcatcatgtcctaggttttcccatgtagagacagcattcatctttcacatggaatagacttagaagtatagatccacacgaggtcaggagttcaagaccagcctgaccaacatggtgaaaccctgtctctactaaaaatacaaaaattagctgtgtgtggtggcacatgcctgtaatcccagctactcgggaagctgaggcaggagaatcacttgaacccaggaggcgagtttgcggtgagccaatatcacgccactgcattccagcctgggcaacagagyaagagtctgcctcaaaaaaaaaaaaaaaaaaaaaagtatagatccagcatcattagtaggaaaatgtcaaaaacttttttttaatcaccaagtggcaaatgatataccagaaagaatactggacttggtgattctaggttctagtctccatctctgctaccagcaaaaactacatctagcagaacagtggtgaggctcaacatttttgataaagggaggacctgaggtagaaatatggtactggtacctgcatgtggctatgggcttaggaagaaccactcccgcggtgtacacagcctg

SEQ ID NO: 81545 - DNA, 601 bp, Human
ataaaataaataaataacttttcgctgggtgcagtggctcatgcctgtaatcccagcaccttgggaggctgaagcaggcggttcacttgaggtcaggagtctgaggccagcctggccaacatggtgaaaccccatctctattaaaaatgcaaaaattagccgggtgtggtggcgggtgcctgtagtcccagctacttgggaggctgaggtgggagaatcgcttgaacccgggaggcagaggttgcagtgagctgagattgtgccattgcgctgaaggggcaacagagcaagactgtctccwaaaaaaaaaaaaatgacaacttttcacattgagaacgagatagtttaagaagatgataatttaatgagacattatttccactcgctgggtctctcctctacacttgattcctgagttccaacgcattaagagatcagcagcctggacttttcttccttcttacttaacagaccataaatttcccaaatttcaaaacttacttgccttgagttcagtcttatccaactaccaatgaaacaactttaagagccttgggaaaaaaggaaagattggcatttccaaacaaactccctaccttcc

SEQ ID NO: 81546 - DNA, 601 bp, Human
aaataaaataaataaataacttttcgctgggtgcagtggctcatgcctgtaatcccagcaccttgggaggctgaagcaggcggttcacttgaggtcaggagtctgaggccagcctggccaacatggtgaaaccccatctctattaaaaatgcaaaaattagccgggtgtggtggcgggtgcctgtagtcccagctacttgggaggctgaggtgggagaatcgcttgaacccgggaggcagaggttgcagtgagctgagattgtgccattgcgctgaaggggcaacagagcaagactgtctccaaaaaaaaaaaaaatgacaacttttcacattgagaacgagatagtttaagaagatgataatttaatgagacattatttccactcgctgggtctctcctctacacttgattcctgagttccaacgcattaagagatcagcagcctggacttttcttccttcttacttaacagaccataaatttcccaaatttcaaaacttacttgccttgagttcagtcttatccaactaccaatgaaacaactttaagagccttgggaaaaaaggaaagattggcatttccaaacaaactccctacctt

SEQ ID NO: 81547 - DNA, 601 bp, Human
gagctctattaaaaaacagtagtgttgttatctgtcaagttgtggtacaaaccgtttgagagccaagattccagagaagagatgtaagcaatgattatggttatttatatgattcaaaaaggagcaaacagaatgctaaccactaaaaaaaccatctaatgccactaaatatagaacaccttatatgcctcgacatgtctaagcaagcacaccctccttgcagcacagtgctaagaccttagtggatcattctctgacttctgctttttatcaacatcaaattacctttcagctcattgamacagatgcgcaaaatcgaacttggaaatactcaacaccagatcaaaaaaacaaaacaaaataaaatctccccaaacactgaaagggtagggaggcatcgtaaggcgtgtttcttggggaaaccttagtattttaggtaacagttgtgaatggcgcaggccctgcgacagctctgcttctggccagcagactctgagcaagtcaatctgtgttctcatggccccttctgtgctatggggataaggacccatcctcctgtggctgttgtgattagtaaatgagactacggctgttaaatgtc

SEQ ID NO: 81548 - DNA, 601 bp, Human
gcaggcggatcacaaggtcaagagatcgagaccatcctggccaacatggactaaaatacaaaaattagctgggtgtggtggcacgtggctgtagtcccagctactcaggaggctgaggcaggagaattgcttgcatccaggaggcgggggttgcagtgagccaagatcgcatcactgcactccagcctggcgacaaagcgagacttcgtctcacagaaaaaaaaaaaaaaaaaaaaaaaggaaataacttttgaaaagcaaaacaaacactcaaattataactattgtcctcagaaagaascaggaaggctattgggcttacattaaaatggctagcttccgtataatggaatagtgaagcggtcatgttttctgagagttcaataaaatgcagagaatcatttccagtaaataagaaaaatctcagtttcataagcaaactctgtatctgaatcagatatcctttcccatggcccaactaatatgcatgattcatgggcctctacgtagattgaaatctgtgtaaaatctgcttataagtacataaggaaatgaagctcagagctctattaaaaaacagtagtgttgttatctgtcaagt

SEQ ID NO: 81549 - DNA, 601 bp, Human
ggggaatgggaggtgcatgctctgtatttatacaccaacagtcctcagctgaatatttactataagccattctattatgatgatgtcatgtctaaagcacttcagctaaaatgccatttaataatctaaatttagagaatttaagtccttcacatttaacaggcaatgcatacctttagtcttttagtacctctcaaaaccaatgagtcagaaatgtccagatctccactggaaataaataagcacttctaaatgctagtgggaagaccaaaaccatataaaatatatatcatagtcattwaaaaaattagtttctgctatgaggcagacttagcttgataaatttcaaatagcctttctcaatatcagaattttttttcttttgttactggttcagtaacaatcaacaatatcaagcaattagatgaattaatgaaagccacaggatatatgatatctgttaatagagaacattcagaaatgaaaaaaaaatttgccaacttccttctagagcaaaacattcttctggagcacaattctcattcattgaatatccaactgtgaaaccactaaaggaactgcccagcagatcgccttaaag

SEQ ID NO: 81550 - DNA, 601 bp, Human
ttttcataacactaagaagttgtttgccttgttgacaagttaccatcagcatcaacggtgcaaagcagtgctgtgggtaaagctgctggtgccttagcacaaaacaagacaatggcaccagaccacactcatggttaccatattcctcaacaccacaccctcatggttcaacaaatggcagtttcacttaagcatgtccttgatagagtattcagaattattaatcttattaactctctaccctttagtacacatctttgtaatgttctgtgatgaaatagaaggaagtgtgtgtaaatamttctgctgcacgctgaacacaaagggtgcttcaaggagaagctttatgtttatcaccttgtctttacctccactacaaacgtgtcaataatgtgctcccgggggaggaaccagtgggctacttcctcttcatccatcactggagccagatgaaactgcttcaggtaagtgttgattaattctcgaactgatttgatatcttttggttccattggtctcaaacctgaagtctttgtaaccttgttggaggggaaacaaaacaaatccagaagttcaggtagaagaggagtgaaacgacttt

SEQ ID NO: 81551 - DNA, 601 bp, Human
ctatttggcaatttctaaaaatgtgaaagatgggtccaaccacagactcagcagctctaatgatatgccctggaaagcagttcccaaaatgtggtctgtgaaccctgtgggtacctgagaccctttcagaaatctgtgaggtcaaaatgattttcataacactaagaagttgtttgccttgttgacaagttaccatcagcatcaacggtgcaaagcagtgctgtgggtaaagctgctggtgccttagcacaaaacaagacaatggcaccagaccacactcatggttaccatattcctcaayaccacaccctcatggttcaacaaatggcagtttcacttaagcatgtccttgatagagtattcagaattattaatcttattaactctctaccctttagtacacatctttgtaatgttctgtgatgaaatagaaggaagtgtgtgtaaataattctgctgcacgctgaacacaaagggtgcttcaaggagaagctttatgtttatcaccttgtctttacctccactacaaacgtgtcaataatgtgctcccgggggaggaaccagtgggctacttcctcttcatccatcactggagccagat

SEQ ID NO: 81552 - DNA, 601 bp, Human
cactttgggaggccaaggcaggtgaatcacctgaggtcaggagttcaagaccaagcctgaccaacatggtgaaaccccgactctactaaaaatacaaaaattagccgggcatggtggcgcacgcctgtaatcccagctactcgggaggcggaggcaggagaatagcttgaacctgggaggtggagtttgcagtgagccgagattgtgccactgcactccagcctgggcaacaagagcaaaattccatctcaaaacaaacaaacaaaaaacctttcataaatcagtaagacaactacggtcaaaaaaaaaaaacaggcaagtgatgtaaatagcaagtttataaaagaaataaacatggctaacagattgatgagatactcaaattcatcaacaatgaggatataaattaacaagatactgttccatactcatcaggtgggcctaaataaatttaaaatctgaccatacccacgtcttgtgaggatgcaaggaaacaggaactctcttacactgctcaggaccttattgtggtgagctatttggcaatttctaaaaatgtgaaagatgggtccaaccacagactcagcagctctaatgatat

SEQ ID NO: 81553 - DNA, 601 bp, Human
aaataaatgtagagacattccatgttcatggactggaagacttttcaattatcctcaaattaatctatcagtgtaatgtaatccctatcaaactaccagcaaggtattttgtaggcaaaaataagcttattctaaaatgtatatgcaaaaggcaaaggaaataggttaattaaaatgatcttgacaaacaagaataaagtgggaggaattactctacctgatactaaggcttcctatatcgctatagcaacgaggtcagtgtggtattagtgaaaagacagacatggagatcaacgaaatrgaatatagaggacccagaaaggaacgcaatacaaagtgttagtattcagcatataaaaaacctttcacgggctgggcacagtggctcacacctataattccagcactttgggaggccaaggcaggtgaatcacctgaggtcaggagttcaagaccaagcctgaccaacatggtgaaaccccgactctactaaaaatacaaaaattagccgggcatggtggcgcacgcctgtaatcccagctactcgggaggcggaggcaggagaatagcttgaacctgggaggtggagtttgcagtgagc

SEQ ID NO: 81554 - DNA, 601 bp, Human
acacaaccgtagtggtatacacgtttcatgcacccatggaatatccatcaagacagtccatatcccgagtaataaaacaaacctcaagagccttaaaataatcaaaaccatacagtgtgtgttctttaaccataattgaatcaaactagaaatctgtaatagggagacaacagaaaatctctaaacacagcaaaattgaacagcacaattctaagtaggggtgggctaaagaggaagcctcaaacgaaaccaaaaaatacatagacgtgaatgacaacgaagatacaacataccaaaataygtcagaaatagctaaagcagtgcagagagggaaactgatagaactaaatgcttactagtaacagggaaaggtctcaagtcagtaagttcttccctcaaggaactagaaaagaagagcaaaataaacccaaagcaagcagacagaaggaaacaataaacacgagggtagaaatcaatgacactgaaaacaggaagacaacagggaatatccaacaaaagtctggttctctgggaaacaaatcaataaaatgatacaagtctaccaatatggacaaaaacaaagaaagagaagacacgaatc

SEQ ID NO: 81555 - DNA, 601 bp, Human
aattgccatacaaagaacactccacacaaccgtagtggtatacacgtttcatgcacccatggaatatccatcaagacagtccatatcccgagtaataaaacaaacctcaagagccttaaaataatcaaaaccatacagtgtgtgttctttaaccataattgaatcaaactagaaatctgtaatagggagacaacagaaaatctctaaacacagcaaaattgaacagcacaattctaagtaggggtgggctaaagaggaagcctcaaacgaaaccaaaaaatacatagacgtgaatgacaaygaagatacaacataccaaaatacgtcagaaatagctaaagcagtgcagagagggaaactgatagaactaaatgcttactagtaacagggaaaggtctcaagtcagtaagttcttccctcaaggaactagaaaagaagagcaaaataaacccaaagcaagcagacagaaggaaacaataaacacgagggtagaaatcaatgacactgaaaacaggaagacaacagggaatatccaacaaaagtctggttctctgggaaacaaatcaataaaatgatacaagtctaccaatatggacaaaaa

SEQ ID NO: 81556 - DNA, 601 bp, Human
caagtgatagaactgctagacagaaaatcagcatggaaacagaagagctgaataactcaattaatcaacatgatgcaattgccatacaaagaacactccacacaaccgtagtggtatacacgtttcatgcacccatggaatatccatcaagacagtccatatcccgagtaataaaacaaacctcaagagccttaaaataatcaaaaccatacagtgtgtgttctttaaccataattgaatcaaactagaaatctgtaatagggagacaacagaaaatctctaaacacagcaaaattgaacrgcacaattctaagtaggggtgggctaaagaggaagcctcaaacgaaaccaaaaaatacatagacgtgaatgacaacgaagatacaacataccaaaatacgtcagaaatagctaaagcagtgcagagagggaaactgatagaactaaatgcttactagtaacagggaaaggtctcaagtcagtaagttcttccctcaaggaactagaaaagaagagcaaaataaacccaaagcaagcagacagaaggaaacaataaacacgagggtagaaatcaatgacactgaaaacaggaagacaacag

SEQ ID NO: 81557 - DNA, 601 bp, Human
tgacagtgttggaaggagaaatagacaaatccacaattacagctggggacttccatgcccctctcatcaagtgatagaactgctagacagaaaatcagcatggaaacagaagagctgaataactcaattaatcaacatgatgcaattgccatacaaagaacactccacacaaccgtagtggtatacacgtttcatgcacccatggaatatccatcaagacagtccatatcccgagtaataaaacaaacctcaagagccttaaaataatcaaaaccatacagtgtgtgttctttaaccatawttgaatcaaactagaaatctgtaatagggagacaacagaaaatctctaaacacagcaaaattgaacagcacaattctaagtaggggtgggctaaagaggaagcctcaaacgaaaccaaaaaatacatagacgtgaatgacaacgaagatacaacataccaaaatacgtcagaaatagctaaagcagtgcagagagggaaactgatagaactaaatgcttactagtaacagggaaaggtctcaagtcagtaagttcttccctcaaggaactagaaaagaagagcaaaataaacccaaagca

SEQ ID NO: 81558 - DNA, 601 bp, Human
ttaaaagcaggtctggtcacagtaatatacaataaagtatactccagagcaaggaaaattattagaaagagaggtattacattatgataaaaagatcaatccactagggagacacaaagaccctaatatacatgtgagtatcaaacaagaggcccagaagaaatcaagaaaaactgacagtgttggaaggagaaatagacaaatccacaattacagctggggacttccatgcccctctcatcaagtgatagaactgctagacagaaaatcagcatggaaacagaagagctgaataactcarttaatcaacatgatgcaattgccatacaaagaacactccacacaaccgtagtggtatacacgtttcatgcacccatggaatatccatcaagacagtccatatcccgagtaataaaacaaacctcaagagccttaaaataatcaaaaccatacagtgtgtgttctttaaccataattgaatcaaactagaaatctgtaatagggagacaacagaaaatctctaaacacagcaaaattgaacagcacaattctaagtaggggtgggctaaagaggaagcctcaaacgaaaccaaaaaataca

SEQ ID NO: 81559 - DNA, 601 bp, Human
cccgctcacaacaaaacccaccatggcaccatgtctagatggcttataagcaacttctaacaactttcaaggaacaagtaatccctattattacatacactgttccagagaaaagagaggacaagctcttcagctcattctaactttggtatcaagacaggacaaggacagggtaagaaggggaaattaatggccaacctcagtagtgagtatagaagatcctaagtaaaatattagcaaactagggctgggcatggtggctcatgcctgtaatctcagcacttggggaggccaaagtggstggattttctgagctcagaagttcgagaccagcctggccaacgtggtgaaaccccgtctctactaaaatacaaaacattagcagggtgtggtggcatgcgcctgtagttccagctacacaggaggctgagcacaagaattgcttgaacccaagaggcggaggttgcagtgagcagagattgcaccattgtactccagcctgggtgacagagcaagacactgtctccaaaaaaaattaaaaaaaaaaattgggaaactaaatctaaaaacagaggtagtctcacacaaatggaaaccaaaa

SEQ ID NO: 81560 - DNA, 601 bp, Human
gtttaataaggattttagattcttctaagaatttctcatatccatctcatacgctgaattactgcaggcacctgcagaacctgattaggttccccaccccattttcatcatctgctttcagaaaactacttcttcacattcatattgctggtaaaattactgtttcctctcttgctgttaaaatgaccagagaatcaccaactgttggggaagagtgggatgatctttccattgtccctcacacccaatcaattgtaaagactgataaaaaacaaaacaaaacaaaacaaaacaaaaaaamcccgctcacaacaaaacccaccatggcaccatgtctagatggcttataagcaacttctaacaactttcaaggaacaagtaatccctattattacatacactgttccagagaaaagagaggacaagctcttcagctcattctaactttggtatcaagacaggacaaggacagggtaagaaggggaaattaatggccaacctcagtagtgagtatagaagatcctaagtaaaatattagcaaactagggctgggcatggtggctcatgcctgtaatctcagcacttggggaggccaaagtgg

SEQ ID NO: 81561 - DNA, 601 bp, Human
aaactaaaggggttaatctacagtgattccctactgctctatattagcagctcagtattggagatgaattcaaccttcaggtttaataaggattttagattcttctaagaatttctcatatccatctcatacgctgaattactgcaggcacctgcagaacctgattaggttccccaccccattttcatcatctgctttcagaaaactacttcttcacattcatattgctggtaaaattactgtttcctctcttgctgttaaaatgaccagagaatcaccaactgttggggaagagtgggaygatctttccattgtccctcacacccaatcaattgtaaagactgataaaaaacaaaacaaaacaaaacaaaacaaaaaaaccccgctcacaacaaaacccaccatggcaccatgtctagatggcttataagcaacttctaacaactttcaaggaacaagtaatccctattattacatacactgttccagagaaaagagaggacaagctcttcagctcattctaactttggtatcaagacaggacaaggacagggtaagaaggggaaattaatggccaacctcagtagtgagtatagaagat

SEQ ID NO: 81562 - DNA, 601 bp, Human
catctttaacttccaaacacttttcccttttttcttttcttttttttttttcggagacagagtctcgctctgttgcccaggctggagtgcagtggcatgatctcggctcactgcaacctccacctcccaggttcaagcgactctcctgcctcagcctcccaagtagctggcattacaggcgtgtgctgccatgcctggctaacttttgtatttttagaagagacaaggtttcaccatattggccaggctggtctcgaactcctgacctcaagtgatcctcctgcctcggccttccaaagtkttgggattacaggcctaagccactgtgcccagcccgctttttactttttcactgcagccttgacctcccaggctcaagagatccttccacgtcagcctcccaaagctctgggattacaggcacactttttgtccattacatagggcaagaccagtattccctgcagggtagtgatctaaaattacattttcaataaagtctatttaagtgtataatagtgagtcattttcaatgatgtgcaaacaccagaccaggtgggtgtggacatggtggaagcgggaggatgggctttgagcatga

SEQ ID NO: 81563 - DNA, 601 bp, Human
atagtgagtcattttcaatgatgtgcaaacaccagaccaggtgggtgtggacatggtggaagcgggaggatgggctttgagcatgattggacttggggaaacaggaatctgggaactgaaaccatctgtcgtcttgaccagaaaagtcccccgctgctgcaggaggcatggattaaccacgtgtctggaaacatgagaccaaatagtggctaaaaacctcctagattagaacccatttcaggtggcagaatgctggcgtgactcggaggtgtggggctgagtgggcgagtccacatttccwcgttgggatatgaggggatgaggtggctgctcagtgacaggacccctgtcccgcaggagaccctttcccaaggcccctgaaactccccgggccctgcccaaaggcttggctgaggccggcatcaccatctcccctccttcccctcttctcccactaggctttcctgtcctggacgccaatgacctagaaggtgagtcagactggactctcacccgtcacacccccaaattctcccctgggtggggaaggcctgcatcctggctgtaatcctggattcatgatcttttttctttccttgca

SEQ ID NO: 81564 - DNA, 601 bp, Human
ccctgtcccgcaggagaccctttcccaaggcccctgaaactccccgggccctgcccaaaggcttggctgaggccggcatcaccatctcccctccttcccctcttctcccactaggctttcctgtcctggacgccaatgacctagaaggtgagtcagactggactctcacccgtcacacccccaaattctcccctgggtggggaaggcctgcatcctggctgtaatcctggattcatgatcttttttctttccttgcagataaaaacagtcctttctactatggtgagagcccgtgcccccwttcccctccccacaaccccacatactgcttggtgccaagggttcccatacagggttggggcctgacgtgagcatcacaggacaaagatacgaagggactaggatggggttactgaatatgccacacagtggattaaaggaactagaggcagcaacctggcctttgggaaggttctattccagcaagatagacacacgcaggaggtgaggacagtttgcaagaagccattggttggttcagatcaactgctgggagaagtgttgacttgagaaaacttcctggaggtggtgagctattgga

SEQ ID NO: 81565 - DNA, 601 bp, Human
gagtagctgggattacaggcgcctaccaccatgcctggctaatttttgtatttttagtaaagacggggtttcaccatgttggccaggctggtctggaactcctgacctcaggtgatccgcccaccttggcctcccaaagtgctgggatatcaggcgtgagccaccatgtctagccaaaaacgcaatcacttttgctccaacctaataggtgtcagccactatgcccagcccgccctctgactttccatctcccaccccacttatttttcttcaaaccacttatctctgcctgaccctgcaygacagatcgtgtttgctggtgtgtgaaccagaatgtgagcacctgggattttgtctgttttcttatggcggtgtccccagcaccctgtgcatcctaggtgctccatatatatttgtcaagagaatggggggacagatgaagaggacacaggctggcactgaggtcccctccactttcctcctagactggcacagcctccaggttggcgggctcatctgcgctggggttctgtgcgccatgggcatcatcatcgtcatgagtgagtggaggagctcgggggagcaggcgggccggggctgg

SEQ ID NO: 81566 - DNA, 601 bp, Human
tgctgggatatcaggcgtgagccaccatgtctagccaaaaacgcaatcacttttgctccaacctaataggtgtcagccactatgcccagcccgccctctgactttccatctcccaccccacttatttttcttcaaaccacttatctctgcctgaccctgcatgacagatcgtgtttgctggtgtgtgaaccagaatgtgagcacctgggattttgtctgttttcttatggcggtgtccccagcaccctgtgcatcctaggtgctccatatatatttgtcaagagaatggggggacagatgragaggacacaggctggcactgaggtcccctccactttcctcctagactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaagatactgttccggcatgcccgcctcaggctgactggacgcttttcagggtgaaagggctaa

SEQ ID NO: 81567 - DNA, 601 bp, Human
ctcaggggaacacggaagtggtgtgtgtgtgtgtgtgtgtatgtgtgtttgcacactggaaagaaaagaactcaatccaccctcacaaacggaccccatcacctcccgcaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttwatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggac

SEQ ID NO: 81568 - DNA, 601 bp, Human; identical to SEQ ID NO: 81562

SEQ ID NO: 81569 - DNA, 601 bp, Human; identical to SEQ ID NO: 81563

SEQ ID NO: 81570 - DNA, 601 bp, Human; identical to SEQ ID NO: 81564

SEQ ID NO: 81571 - DNA, 601 bp, Human; identical to SEQ ID NO: 81565

SEQ ID NO: 81572 - DNA, 601 bp, Human; identical to SEQ ID NO: 81566

SEQ ID NO: 81573 - DNA, 601 bp, Human; identical to SEQ ID NO: 81567

SEQ ID NO: 81574 - DNA, 601 bp, Human
aggcatgtctgagccactctggtgtttgtcacgatgctggggggtgggggtcacccgcagacatggatgatggagccccgcctgcggagttgctgtgacaaagatgcctgcggtactgggactttacaaaacctgtgttattgctcttgcaaatctgcagaggtgagatggggagagggtgggaggctccagggcactgttcagccacccaggttctttccatcttgttgtttggcagttggccagggtgttgtgtcctctgtacgccgtgacccaatagagcctcttttttttttttttwaaatttagatttttattttttgagacggagttttgctattattgcccaggctggagtgcaatggcgtgatctcggcccactgcaacctctgcctcccaggttcaagtgattctcctgcttcagcctcccgagtagctgggattacaggcatgtgccaccaagcccagctaatttttgtatttttagtagatatggagtttccccacattggccaggctggtctcgaactcctgaccttaggtaatgatccacctgccttggcctcccaaggtgctgggattacaggtgtgagccactgcg

SEQ ID NO: 81575 - DNA, 601 bp, Human
gctctgtcacccaggcaggctggagtgcagcagtacaatgtcggctcactgcacctcccgggctcaagcgattcttctgcctcagcctcccaagtaggtgggattacaggtgcacgccaccatgcccaactaatttttgtacttgtagtacagacggggttttaccatgttggccaggctggtctcgaactcctgacctcaggtgatccacccacctcagcctcccaaagtgctgtgattacaggcgtaagttaccatgcccggcctattattattattattattattattattattattwcaagttagagtctcactctgtcacccaggctggagtgcagtggcacgatcttggctcactgcagcctccatccacctcccgggttcaagcgattctcctgcctcagcctccgaagtagctgggattacaggcacgcgccaccacgcccggctaattcttttgtatttttagtagagacagggtttcgctatgtagaccaggctggtctcgcactcctggcctccagtgattcacccaccttggcctcccagagtgctggaatgacacgtatgagccaccacactgacctttttattattt

SEQ ID NO: 81576 - DNA, 601 bp, Human
agcctggccatcatggtgaaaccccatctccactaaaaatacaaaaattagccagttttggtgacatacgcctgcaatcccagctacttgggagactgaggcaggagaatcgcttgaacccgtgcggcagaggttgcagtgagctgcgattgcgccactgcactccagcctgggcgacagagggagactctgtcaaaaaaaaaaaaaaatttcctcatccccattcccagctaaccctccagaagcagcctttgtaaagtttcctgtagccaggcgcagcagctcatacctctattcccarctattcaggaggctgaggtgggaggatggcttgagcctgggaagttgaggctgcagtgagccatggtgacaccactgcactgcagcctgggcgacagcaagatcgtgtctctaaataaatttaaaaaatagaaaagttttcctgtgaagtcttccagaaagttcctgtgcacatacacatctgtcatctcctctttgaaacacgtacacatgtgcacatgcacacaggttggttttctccctgctcctctgaagcttatttccacctggaagtatgtaagcagtgtccgtgtgtcagtga

SEQ ID NO: 81577 - DNA, 601 bp, Human
tgtcctcatgacaaggcagcttatttctcccagagtgagtgatccaatagagagtaaggcagatgcctggaggtcttttgtgacctaatatcaggattcacattctttcttttttttatttttatttttttgagacagagtttcactcttgtcacccaggccagagtacaatggcgtgatcttggctcactgcaacctccggtccccggctcaagcgattctcctgccttagcctcctgagtagctgggattacaggtgcccgccaccatgcccgcctttttttttttttttttttttttwaatttttttagtagagatggggtttcaccattttggccaggctggtcttgaactcctgatctcaagtgatccgcctgccttgccctcccaaaatgctgggattacagggtgaaccaccacgcccggctacactctttgatttctataataccccgttggtgttacagatcagctctggtcatcatgggaagggactgcatcagtgggttaatgccaggagacaaggaccactggtcaccatcttagaaggtgggggactatcatagtcccgcttctggcgcctagtgattgattttgttc

SEQ ID NO: 81578 - DNA, 601 bp, Human
ggactgcatcagtgggttaatgccaggagacaaggaccactggtcaccatcttagaaggtgggggactatcatagtcccgcttctggcgcctagtgattgattttgttccttccacacacagataccccactcactttctcctaagtccatattctgttacagtattagaagtctgttagaagtctagaacctcattttgtcaagtacaggtgtagtagtacctgcatttcctttagtacagttcctttcaatctgaagacatgagaatttaaagagacaaattacccctcacacacccarcatacaatggtgaggtgggcatgggatgactggtatgtatgggataattatttcttttcttttctttcttttttctttttttctttgttttttttttttttgaggtagggtctcacactgtcgcccaggctggagtgcagtggtgcagtcactgctcactgcagcctcgaactcctgggctcaagcaattccccacctcaaccttctaagttgctgggactacaggcacatgtcaccatgcctggctacttttttattttttgtagagatgacgtcttgctatgttgcccaggctagttt

SEQ ID NO: 81579 - DNA, 601 bp, Human
tctctggatgggtgcataggtcacccctcccagcacaggcggaagctatgcagaggcatgaattccaggaagcaaggatcactggtgtctgattggagactggctgcgggtctgatactcctttccccagcatagcccagtcacagttttcaacatttcacatctcttggtctctggcatagcagattctgccgagttatccctggttttgcaaattctgacagtgtcgctgtaaggtagggatgtctcactgttgtaaccaggaaagagtctagttggtggtgagtgtggcagggaccastgtggtctccagagactcctatgccttgtgtagtggctcacgcctgtaatcccaacactttgggaggtcaagatgggaggattatttgaggccaggagttagagaccaggctgggcaacgtagcaagacgctgtctctacaaaaaataaaataggctttgcgtggtggctcatgcctgtaatccaagcgctttgggaggccgaggcaggtggatcacctgaggtcaggagtttgagaccagcgtggccaacacggcgaaaccccatctctactggaaatactaaaaattagctgggcagg

SEQ ID NO: 81580 - DNA, 601 bp, Human
ggagtgcagtggcgtgatcttggctcactgcaacctctgccttccaggttcaagcgattctcctgccttagcctcccgagtagctgggattacaggtgcacgccaccatgcccagctattttcgtatttttagtagagacggggtttcaccacgttggccaggctggtctctgactcctgaccttaagtgatctgcccacctcagcctcccaaagtgctgggattacaggtgtgtgccaccatgtccagcttattttttgagacaaggtcactctgtcactcaggctagagtgcagtggtrcgatcttggctcactgcaacctctgccttctgggttcaagtaatttttatgcctcagcctgctgattctgggattacaggcgcccactaccacgtccaggtaatttttgtatttttggtagagacaggttttctccatggtggccaggctggtctcgaattcttgacctcaagtgatctgcccacctcggcctaccaaagtgttgggattataggcatgagccactgtacccggcccacttagtgactgtatgagtaggtgatgccaggattagaacctgggtctcctgtctccaagttc

SEQ ID NO: 81581 - DNA, 601 bp, Human
gtctccaagttctcacagtctgcctggcctcgaggttgtgcaggctcagcagggcatgacagagtgagggatgctccaggagtgacagcagcagtcagccagtgggcactgtgctgtgtcagagctggggactacacccacatctccctcccaccccctccaccatcatccccacatctctgcctccagtgcctacccagctgcagcaggacgccataaggctggctaaccatagcactgttgcctgcctgcaactgactggtcagtagggcttctcctcctatgtggaataggtaaggarttgctggccctgtctgccctggggaccagaatacctgatggctcctcagagcttcctggtgcagtcaccctcccacacatgggaagggctgggtggctgttcagcctgtgtttgtttgcctggcctggtaggtggcccctgcccacacttgggtcccagtcctaggttcggttcccagatgtccaggggtatcatgctctggtgtcccaggcaggcctgggtgagagctgttgcagagcagtgtgtgggccaggtcctcacacggggttacagctgccctcagcagggggctttgcaggc

SEQ ID NO: 81582 - DNA, 601 bp, Human
ggctgtctccaggcatttggaccagaggccctttgcttggtgatggcatccacagacataacctcattcctttgaaagctctaaaggccttttactaccagggtctgggagagaatgaagccctaatcccttaagccatccactgtgtataatgagttaacttctttctagaatgagactagttacataccatccttggaagaattgacgagaatcactcaagtcattttctgcatcctgtggctcagatgcggaacactggtcaagagagactgtgcggcttctaataaatgttgcatgsctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctgga

SEQ ID NO: 81583 - DNA, 601 bp, Human
cagggcgtcagaggcctctgagaatttgtgactgaagtccaagtctgtggcatcagggtctgcagagcccagatgcgggagaggtaggaatgtacctggtgatatgaggcaaggacaggggagctggggcaggtgaggcaggcaggtggcatgaggagctgtgctgggtgggtgcggtctgagtggctcaggttgggtaaagggccagagacctgggtctacagggcagacatcaaggctgagccagtcagacagtgtttgtcaacactgggctctcaccaggctccctcaggccgaggtsagcagccagggatctgtcatgtgtgaggaaagtgtctgttcaggttaggtgtgtataatgcagcctttcagagccgcgtctgtctgaggtcctaggagctggaatcagacaggtttgtatggctgggtttctaggggaggcctgaggagccaagactgtactcaggtaggcagaactggaccagtctggtaaggacgttggagctaaagataggcagacaggtcgagctgggtctgacaagtgagggctgaaaatctgtgattgggtccaggttggagctgtgtccttgggcgatgtctg

SEQ ID NO: 81584 - DNA, 601 bp, Human
gataggttgaccggaacagccatggtcaaaccaattaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcamtttggaaggccaaggcaggcagatcagttgaagtcaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcacttt

SEQ ID NO: 81585 - DNA, 601 bp, Human
ttaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcaatttggaaggccaaggcaggcagatcagttgaagycaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcactttgggaggccaaggtgggtggatcatctgaggtcag

SEQ ID NO: 81586 - DNA, 601 bp, Human
gcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtgrcacacgcctgtaatcccagctactcaggaggctgaggcaggagaattgcttgaacccgggaggtggggtttgcagtgagccgagatcatgccactgcactccaacttgggcaacaagagtgaaactttgtctcaaacaaaaaccaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatca

SEQ ID NO: 81587 - DNA, 601 bp, Human
cagtgagactatctccaaaaaaaaaaaaaaaaaaaagcgggggttgggtgtggtggctcatgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtggcacacgcctgtaatcccagctactcaggaggctgaggcaggagaattgcttgaacccgggaggtggggtttgcagtgagccgagatcatgccactgcactycaacttgggcaacaagagtgaaactttgtctcaaacaaaaaccaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatcaggtctgaagaacgggagttaaacacaggtgtgtagaacagggtttggcaggtaaggtctttggagccaggatcagggcagcttcacaaagctgagtgtgtt

SEQ ID NO: 81588 - DNA, 601 bp, Human
catgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtggcacacgcctgtaatcccagctactcaggaggctgaggcaggagaattgcttgaacccgggaggtggggtttgcagtgagccgagatcatgccactgcactccaacttgggcaacaagagtgaaactttgtctcaaacaaaaaccaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatcaggtctgaagaacgggagttaaacacaggtgtgtagaacagggtttggcaggtaaggtctttggagccaggatcagggcagcttcacaaagctgagtgtgttcatgagacctaaaaagtcatagtcaagcccaggtaagaagaaccaagtgtgttggatg

SEQ ID NO: 81589 - DNA, 601 bp, Human
cagacacaggatgtggactgccgaggccaggctcacataaataaagctggaccctgggaggctgtaaggaatctgagttgggcttaggcaagggaaccgggtctgtcagtcaaggtgtgaggggtcaggttatgtgaagcctggtctatcagctgagatgtctggaacccatctttgacaggtatataactctgtagcctgaggcactggagttggacacaaataggcagaactaggtctcccaggtgaaaccattgcatcgatgctcagtgctggtatgtttatctggtgttgtcagtgagtctgccgatgcaggctcagtgctggtatgtttacctgattatgtcagtgagtctgtggatccaggctcagtgctggtatatttacttggttgtgtcagtgagtctacggatccaggctcaatggtggtatgtttacctggtgttgtcgtgagtctgtggatccaggctcagtgctggcatgttgacctggtgttgtcagtgagtctgtggatccagggtcagtgctggtatgtttagctgacattggcagtgagtccatggatccaggctcagtgctggtatgttgacctggtgttgtc

SEQ ID NO: 81590 - DNA, 601 bp, Human
agtgaggaaagttgccaggcgcagtggctcacgcctgtcatcccagcactttgggaggccgaggtgggtggatcacttgaggtcaggagtttgagaccagtctggtcaacacggtgaaaccccatctcctaaaaatacaaaaattagccatgcatggtggcacatgtctgtaatcccagttactcaggaggctgaggcaggagaattgcttgaacctggcaggcagaggttgcagtgagctgagatcatgccactacactcaggcctgggcgacagagtgagagaccctgtctcaaaaaawaagaaagtgagtaaagtgaggaaaaaggtagatgatggttagataaggtgagatctggggcactggggcaggttaggcccaggacattgaactgactgaggagctgcatctataatgtatggtctcagaggccactgcacttaaaggtgaggtctagagacccatgtctgcagattgagggttcggaggctcaggtcagacactgcttggcattgctgggctgtcacaaaactgggatctgaggacctgttctcggccaaggtgagcagcctggactctgtcagccagagggctggctgt

SEQ ID NO: 81591 - DNA, 601 bp, Human
gtgaggaaagttgccaggcgcagtggctcacgcctgtcatcccagcactttgggaggccgaggtgggtggatcacttgaggtcaggagtttgagaccagtctggtcaacacggtgaaaccccatctcctaaaaatacaaaaattagccatgcatggtggcacatgtctgtaatcccagttactcaggaggctgaggcaggagaattgcttgaacctggcaggcagaggttgcagtgagctgagatcatgccactacactcaggcctgggcgacagagtgagagaccctgtctcaaaaaaawagaaagtgagtaaagtgaggaaaaaggtagatgatggttagataaggtgagatctggggcactggggcaggttaggcccaggacattgaactgactgaggagctgcatctataatgtatggtctcagaggccactgcacttaaaggtgaggtctagagacccatgtctgcagattgagggttcggaggctcaggtcagacactgcttggcattgctgggctgtcacaaaactgggatctgaggacctgttctcggccaaggtgagcagcctggactctgtcagccagagggctggctgtg

SEQ ID NO: 81592 - DNA, 601 bp, Human
gtacgtctctctcccacactctgtgtccgttgcctgtgctagaaatgtgggaggtgctccataaacagctgttaggaagacatccgtgaagttctgaggactctgatggcaccaagtggagcttgcaggtgtggcttgagaaggtgcagtgtgaatgataggcctaggtgataggccgagaagatcggtcaagcccagatatgacccactgggcctgtcagtgtccaggaggtggggtgaggcacaggtctaaggttctggatctgtcagtaccacctgaggagttgggaatgggcacagktacaaagtgatgagtcttcattgttcaacaaagaatggcacaggtgtgaggatctgggtttgtcagtatctgaggatgtggggcctggcacaagtatgaggcactgggccactgttcaagcaggtgggctggggaacagaaatgtagctgtgggtttttaatatctgaggagacctagccaagtgtagcagagagctgctgggtctttcattgtccaaggaagcatacctgggcacaagtatgagactgagaaggtgggtcctggcaccggtaaggggctctgggtctgcaagtgtctat

SEQ ID NO: 81593 - DNA, 601 bp, Human
caggtatgacatctgggtcttccagtgtgtgaggaggtaggatctggtacaagtatgaggccctgggtctgctggtgtctgaggagataacagcaggttacaggtatgaggccctgggtctgctggtgtctgaggaggtaacatctagtacaggtatgaaatctgggtcttcctgtgtctgagaaggtagcacctggcacaggtatgaggatctgggtcttcccaatgtttgaggaggtagcatctggcacaggtatgaggatatgggtcttccatgtctgaggaggtagcacctggcacrggtatgagaatctgggtcttccagtgtctgaggaggtagcacctggcacaggtatgagtatctgggtcttcccgtgtctgaggaggtagcacctggcacaggtatgaggatctgggtcttcctgtgtctgaggaggtagcacctggcacaggtatgaggatctgggtcttcccgtgtctgagtaggtagcacctggcacaggtatgaggatatgggtcttccatgtctgaggaggtagcacctggcacagatatgaggatctgcgtcttccagtgtttgaggaggtgagtttggactcag

SEQ ID NO: 81594 - DNA, 601 bp, Human
ggtgtctgaggagataacagcaggttacaggtatgaggccctgggtctgctggtgtctgaggaggtaacatctagtacaggtatgaaatctgggtcttcctgtgtctgagaaggtagcacctggcacaggtatgaggatctgggtcttcccaatgtttgaggaggtagcatctggcacaggtatgaggatatgggtcttccatgtctgaggaggtagcacctggcacaggtatgagaatctgggtcttccagtgtctgaggaggtagcacctggcacaggtatgagtatctgggtcttccygtgtctgaggaggtagcacctggcacaggtatgaggatctgggtcttcctgtgtctgaggaggtagcacctggcacaggtatgaggatctgggtcttcccgtgtctgagtaggtagcacctggcacaggtatgaggatatgggtcttccatgtctgaggaggtagcacctggcacagatatgaggatctgcgtcttccagtgtttgaggaggtgagtttggactcaggtttgaggcccttgggcttccagtgcctgaggagatagcatctggcacaggtatgaagccctgagtcttctag

SEQ ID NO: 81595 - DNA, 601 bp, Human
tgtatccaggaggtatgacctcgtacaggcatgagtatttggtattgcagtgtctgaggaggtaggatctggtgtaggtgtgaggatctgggtttgctccctgcccccgtggctgaagaggtaggatctggtacaggtgtgaggatctgcgtctgttcatgtctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatmttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaaaaagtaggatctggccctggtatgaggatctgggtctgtcagtatctgaggaggtaggatctcatacaggtatgaggatctggg

SEQ ID NO: 81596 - DNA, 601 bp, Human
gaggtaggaatctggtacaggtatgaggatctgtgtgtgtgtcagtgtctgaggaattaggaatctggtacaggtgtgaggatcttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaaraagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgagg

SEQ ID NO: 81597 - DNA, 601 bp, Human
gtcgcccaggctggagtgcagtggcacgatcttggctcactgcaaccttcccctcccggcctcaagtgattcttatgcctcagcctcccaagtagctgggactactggcactcaccaccatggccagctaatttttgtagttttggtaaagggggggtttcactatgttggccaggctggtcttgaactcatgacctcaagtaatctacctgcctcggcctccctaagtgctgggattataggcatgagccaccttcctgggctatctgaagagtttctgaagctcaaatatccagcaggycctgatgtgtctctgcttagagtcttgcaggctgaaatcaaggtgtcatcaggactgtgtttctttctggagaccttaggggaaaagcctttgacctgcttgtcaggtggttggcagaattcatttctctatggttgtggaactgaagtccagcttccttgctgtgggctgaaggtcgttctcagattctcagaggtcacctgcatcctctagcttgtgggcctcttcactgcagaaccagcaatggcaggttaaatccttctctgaagctttgattctgtcttgccacttctgttgcat

SEQ ID NO: 81598 - DNA, 601 bp, Human
tgacccctgctgagaagtaccaggcggtcttgtccctctgcctgaagcccagacagtgctctcaagcataactgatgtctcgctcatcagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcrtgcctggcttgtcctacagaatgggagggcctgtcctcacagacctgcacgtctcagcctctggggcagggtgtgcttcccttcaaggggtttagggatcaggactctcttggagacattccttggtgttttctgcaggtctttgaaggaaatcgcccaaccaactctattgtgttcaccaagctcacaccattcatgcttggagccttggtcggtgagtgagtaggggaaaggtcctggcttggggtaggttggaatgggcttgtggagccctgatgtgccctgtctgtcacttctgca

SEQ ID NO: 81599 - DNA, 601 bp, Human
cggtgtctggggttgggaggctcagtattgagaattccccatctccccagagtttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcrggtgagtgcggggtccagagagaaacggcctctgtggggaggagtgaggggcccgcccggtgggggcgcaggactcagggagccgcctccggaggagggtctggcgggtctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggcc

SEQ ID NO: 81600 - DNA, 601 bp, Human
ctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgamcccggccgggggcgcaggtcacgaccaccccccatccgccacggaccgcccgggtccctcagagtctccggatccgaaatctaccccgaggcagcgggacccgcccagaccctccacccgggagagtcccaggcgcctttacccaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgg

SEQ ID NO: 81601 - DNA, 601 bp, Human
ccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccacccsccatccgccacggaccgcccgggtccctcagagtctccggatccgaaatctaccccgaggcagcgggacccgcccagaccctccacccgggagagtcccaggcgcctttacccaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggat

SEQ ID NO: 81602 - DNA, 601 bp, Human
cctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtggrcccaatgctaggatatcgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggcca

SEQ ID NO: 81603 - DNA, 601 bp, Human
atgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtgggcccaatgctaggatatcgccctccctctagtcctgagtaggaagaatcttcctggctttcgagatccggtaccagagagtgactgtgagagtccgccctgctctctgggacaattaagggatgaaatytctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctcccccctcagagactcgaactttccaaggaataggagattttcccaggtgtctgtgtccaggctggtgtctgggttctgtgctcccttccccaccccaggtgtcctgtccattctc

SEQ ID NO: 81604 - DNA, 601 bp, Human
agatctcttgggatggcctcgcacaaggttgggaggaaagtgggcccaatgctaggatatcgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttgrggctctgattccagtccctcggcctccacttaggtcagggccagaagtccctgctcccccctcagagactcgaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccct

SEQ ID NO: 81605 - DNA, 601 bp, Human
cgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctccccsctcagagactcgaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatgg

SEQ ID NO: 81606 - DNA, 601 bp, Human
agtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctcccccctcagagactckaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagac

SEQ ID NO: 81607 - DNA, 601 bp, Human
aaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctcccccctcagagactcgaactttccaaggaataggagattttcccaggtgtctgtgtccaggctggtgtctgggttctgtgctcccttccccaccccaggtgtcctgtccaktctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagat

SEQ ID NO: 81608 - DNA, 601 bp, Human
ctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcycagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaa

SEQ ID NO: 81609 - DNA, 601 bp, Human; identical to SEQ ID NO: 25018

SEQ ID NO: 81610 - DNA, 601 bp, Human; identical to SEQ ID NO: 25019

SEQ ID NO: 81611 - DNA, 601 bp, Human; identical to SEQ ID NO: 25020

SEQ ID NO: 81612 - DNA, 601 bp, Human; identical to SEQ ID NO: 25021

SEQ ID NO: 81613 - DNA, 601 bp, Human; identical to SEQ ID NO: 25022

SEQ ID NO: 81614 - DNA, 601 bp, Human; identical to SEQ ID NO: 25023

SEQ ID NO: 81615 - DNA, 601 bp, Human; identical to SEQ ID NO: 25024

SEQ ID NO: 81616 - DNA, 601 bp, Human; identical to SEQ ID NO: 25025

SEQ ID NO: 81617 - DNA, 601 bp, Human; identical to SEQ ID NO: 25026

SEQ ID NO: 81618 - DNA, 601 bp, Human; identical to SEQ ID NO: 25027

SEQ ID NO: 81619 - DNA, 601 bp, Human; identical to SEQ ID NO: 25028

SEQ ID NO: 81620 - DNA, 601 bp, Human; identical to SEQ ID NO: 25029

SEQ ID NO: 81621 - DNA, 601 bp, Human; identical to SEQ ID NO: 25030

SEQ ID NO: 81622 - DNA, 601 bp, Human; identical to SEQ ID NO: 25031

SEQ ID NO: 81623 - DNA, 601 bp, Human; identical to SEQ ID NO: 25032

SEQ ID NO: 81624 - DNA, 601 bp, Human; identical to SEQ ID NO: 25033

SEQ ID NO: 81625 - DNA, 601 bp, Human; identical to SEQ ID NO: 25034

SEQ ID NO: 81626 - DNA, 601 bp, Human; identical to SEQ ID NO: 25035

SEQ ID NO: 81627 - DNA, 601 bp, Human; identical to SEQ ID NO: 25036

SEQ ID NO: 81628 - DNA, 601 bp, Human; identical to SEQ ID NO: 25037

SEQ ID NO: 81629 - DNA, 601 bp, Human
tgggtgcgggccaggccggggtcggagaggcggaagggtctggaggaatggaatccaccctccctcccgcgacccccacgtcactgactcacccgtgagctggtcgtaggagccgtccaggtctcgggaatcggacaaactctccttgcggccctggccccgcatggcccccggcgccccgctcccgcccgggccgtgggagggggcgccgggtggccgggatagggcgctcacacggcgccccctggcggcctactgtgctgtcggggctggggaagtccgggctgaggctgagtctggsaatgggcccggggtctgaggtctacccggaggtcctggagcaggagagggaacactaggcagcaggtgagcgcagagccggaggcagagcggagctgagcgcggagccgagccgagctgcctctctcctcccgccccctccccgcggctgtcaccgcctcctcccctctttggcgctgccgggattggctccccctacccccgccccccaccctttgcagcccgggggaggcacccggtgaaagggtgaactgcaaagtgcggggaaggagactagctccccagcaatctgcccctaaag

SEQ ID NO: 81630 - DNA, 601 bp, Human
gcactgccacatacaatcacactcaccctagctgtcaccaagcccagggcacatggcaaccagctgtgggaggtgcgcgcgcacacacacacacacacacagaatgacaggtgctcacgcacgtaacacctcccactccagacaccctctcagccctgtgtcacatacgcccacacctgctgcctctccacacctgcctcttctgttcctccccaacccctgcgggacccaaggctttgaacccccagtgtcctgccgcccagaccggccataagagtgcctgggaatggggcagagtgtkggtgcgggccaggccggggtcggagaggcggaagggtctggaggaatggaatccaccctccctcccgcgacccccacgtcactgactcacccgtgagctggtcgtaggagccgtccaggtctcgggaatcggacaaactctccttgcggccctggccccgcatggcccccggcgccccgctcccgcccgggccgtgggagggggcgccgggtggccgggatagggcgctcacacggcgccccctggcggcctactgtgctgtcggggctggggaagtccgggctgaggctgagtctggga

SEQ ID NO: 81631 - DNA, 601 bp, Human
catgtcatgtatgaacttgctagctgagttcatgttggtctaggcccatctcagggttttttccttctggacactgaacccttcatcttaagaccccttcagccaagaaatgcaggaaaggactgaactttttccctgctctgctgcaggcctcctcctttcatccctgggaggcgccctgcccctcagttaaggccccctcctctgccttcggtgagaagccccgccccctccaccattgtgagggaccttgatgcccctctcctttcctctttgaagagcgctgtcttcctcctgctcwgtaaggaggcccatcccctgctccgcttctgtccaggatctcgtcttggaagccctttccttggagggatgttgctccctccatctatttgaggggcccttccctccctacctctgcggagctcctaacccacttcgctcactttttgaaggatcctgcccctcccttcccttcctcatcatacctggggacagcgacccagtcaccagctggtagagggatcgcgctgcctgccccagcgggctccggcacctgcgggggcatcggttcatggtttggcggcgagctcggcgtctaagc

SEQ ID NO: 81632 - DNA, 601 bp, Human
agtatggcttgctctttgagggtgaaataatagtaaactttgtggcaataagagatcttggaggcgagtattctggtgtattgtggggctatccatggcccactgatcatggctccccttcccctcttctcccttatttctgcacatgctctacagctctaattgcacccccagaggaccctcagtgttactgtgtgtgtgtgtgtgtgtgtgtgtgtgtgtgtgtgtgtgtgtgtctgtgtctcccagctgcactgcatccagattcctggatcagatcccactggatctgacacagtgrctaaagttggcctcagtccattcctggaggggtccaacttcctttagttaaaggttactccccctccatataccccaccctcccaatccaggcttcaccctccagatcaggccctgttctcaggaggtgactgggtgagtaaccacctcctctccttcaacacatccttacctccctcccaccccaggagccatggagaggtgggagggaggcagtgggccaggcagggggatcgatggcattcctggcctctggcccagggctccattagcctggactctagtttcccaaagctggatt

SEQ ID NO: 81633 - DNA, 601 bp, Human
gccacgcccccttatgctccagccttgccagcacccgccctcgccacgctggtcacgcccacacacacacacacacacacacacacacgcacgcaggcctggggcacgcccctcccccacacgcaggcgtgcggcacgcctccccatacacacacacacgcgcgcgggcctggggcacgccctccacacacatgcaggggtagggcacgcccccccacacacacacgccggcctggggcacgctcgcgcgcacatgcacacacatacacacgcacaggcctggggcaggccccacccccamacacgcaggcctggggcacgcccccccacacatgcaggcctggagcatgcgcacactcgcaggcctggggcacacgcgcacacactcatgcacagacacgcacgcacacatcgagccccgcccccggaagcacatgagaggcacttgctttcactgactgagggcagggcttggggcccgcagcacggcagcagcttgaggaatcgctgcttcagcgcttttttagtgggccctggagggtggcctgggaagagagaagaccccaggaaggcacattaactcccattgtccctctgttcc

SEQ ID NO: 81634 - DNA, 601 bp, Human
cacagttttgcgggagcggtgacacacacccgctcccaactgaccacgcccacacacgctggcttcagccgcacacgcacacagtagccacgcccccttatgctccagccttgccagcacccgccctcgccacgctggtcacgcccacacacacacacacacacacacacacacgcacgcaggcctggggcacgcccctcccccacacgcaggcgtgcggcacgcctccccatacacacacacacgcgcgcgggcctggggcacgccctccacacacatgcaggggtagggcacgcccccmcacacacacacgccggcctggggcacgctcgcgcgcacatgcacacacatacacacgcacaggcctggggcaggccccacccccacacacgcaggcctggggcacgcccccccacacatgcaggcctggagcatgcgcacactcgcaggcctggggcacacgcgcacacactcatgcacagacacgcacgcacacatcgagccccgcccccggaagcacatgagaggcacttgctttcactgactgagggcagggcttggggcccgcagcacggcagcagcttgaggaatcgctgcttca

SEQ ID NO: 81635 - DNA, 601 bp, Human
acaattccgctgggacattcctggaaggagagggcaccaggctgagggcagagacaaaatccccttccgttcaccgcccccaccctccatggcccaagactcccagggagggggataatcttcaagcctccagaggactcaccacgtggctcatgtgatgggagggaagacttctttcccagtgcacaaataaaaaacatggaacgaaactgacagtctacaggcgccacttccgttctggccccgccccagaacctccagctagaagttcagtctcagggccttgcctcccttccgcccrcacctcaagcatccaagccatgctttctgggaagctgtggaccggcttgggtcctcctgtcccaccctcgctgagtttggcctcgccttgcactcacgttcttgaagccccggtacaggacctgcaactccttgcgcgtgaatttggtttgctcctgcagctgctccagaccctcaggccggtgacacacggtggacaattcaaattcatcgtccacgctgtctgcgggagcggtgaggacagccgcgcctcaggcccagcctccgcgacccctcttcaaatcactgccccattcacccc

SEQ ID NO: 81636 - DNA, 601 bp, Human
gactgagcctgtgtctccagaaagacagtccccacccagccaccaagtctccccaatccacagacaggcagactaaggccacacaggaagcccaaactcacacagcccaccagaggccaggcctgggcaataaacccaagagtagattctcagacctggccctcatcccccaactaggccatcctttctcccatagcttaaccacccctgcctcctcagtttccgggccacttgaaatgtgttagctcaagaacctgaagagacaggaggcaggacgcctgggtttctctccaattttgtaaaaaaaaaaaaaaaaaaactctcagagcctccatttctctctctagagaatgaacaggcattgtctaggcctgggtaaatagctctgaggagctagagcccaaagctctgggcctctatttacacctccagtgaatggacacaaactcagcatctctccagagccacaactcccagtggctccagcacaagggcttgggagtgagtagagaaggggagggacatcacccagaccatctgtccctgttgctgcctgtccccagcagcaggagtagaggcagcaaggtggggggacggagga

SEQ ID NO: 81637 - DNA, 601 bp, Human
aacataatgcatgcacattataagaagacagacaatagagatgttcaaaagaaaagttaattgtccttcctgtactttctcaatgttcctcctccttctttaggcaaatagtgtgaacagcctagtttgaatctttatgtttttctatgtctttataaatgaagtaccattcctttttaaaatgaaataaggccgggtgcggtggctcacgcctgtaagcctagcactttgggtggccaaggcgggtggatcacgaggtcaggagtttgagaccagcctggccaacatggtgaaaccccgyatctactaaaaatacaaatattagccaggcgtggtggcgggcttctgtaaccccagctactggggaggctgaggcaggtgaatcgcttgaacccgggaggcggagtttgcagagagcagagatcgcgccactgtactctaacctgagcaacagagcgagactctgtctcaaaaaaaaaaaaaaaagaatagaataaaatgaaataaaaataggattatgtgctacatattttcttttttcatttaatggtattaacttgaccaggcacagtggctcatgcctgtaatcccagcacttttt

SEQ ID NO: 81638 - DNA, 601 bp, Human
ctggaaacaggattcttgctcgtcgtcatattattttaaataagaatgaaactaaagaagaggtctttgggccaggcatggtagctcacacctgtaatcccagcactttgggaggccgaggctggcagatacctgaggtcgggagttcgagaccagcctgaccaacatggagaaaccctgtctctactaaaaatacaaaattagccaggcgtggcggcgcatgcctgtaatcccagctactcgggaagcctcaggcaggagaatcgcttgaacctaggagacggaggttgcagtgagccakgatctcaccatagcactccagcctgccaacaagagcgaaactccatctccaaaaaaaaaaaaaaagtcttcaatctgctgtaatgtggcactcagatatgagtattggcggcagtgagtgttcatttcctcctcctgctcccctaattcagttgcgcctgaacacaaaactccaaaagcaaccagagagagaagctgtgttgaaagatgaaaggagaaaaggccacaagctttggccctacctggttcttgttctgagtcaaaaactcttgtttccaggcccctcgtctatgaaattagt

SEQ ID NO: 81639 - DNA, 601 bp, Human
tagagagcttaagcacagtcctcagctctatctggattacctggactgggtttggagggaaagggtagtccatctagttgggatcttttttttttttttttttcttggttaccattaaagaggtcattccaaggattagaactctagattgatggaaagaagccaggtgccaggatagcccaggacactgggaatactttgggatctgtgaagatgccctctgtcctctaaaagtcaaggtataggggagcttaggggagggatccaagctaaagattaccctaatctgcatatacctgcyttaggaagaaaggggagagaaggaggtgtgggctgtctgggctgtccatcacaagagtgtgcatgctgaaggtgtggttgtggacatacaggtcactgaaagtaaaaaactctgtgtatgtacacctagctagatagtccattggcccgtgttctctttgaatgcattgtgtcatttcatttgtgtgcttgcacagtctcaagctgcagctctcattagtggctatccagcatgttgccatgattattaacctgggacctgctccttttttgtaaagcttacactgtcctttggagtaca

SEQ ID NO: 81640 - DNA, 601 bp, Human
agtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggcyggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaaaaaaaaaatatgtttatggcttaggcccagctcacataccagtaagaaaaccaggac

SEQ ID NO: 81641 - DNA, 601 bp, Human
gcactccagcctggacagcgaaactctgtctcaaaaaaaagacttactgtatagctatagtagtcaagattatgtggtgtcgatggagggacagacacgtagatcaatggaaaagaatagagagaccagaaataagctcaacacaaatatgttcagtggattttttgaccaagatgtaagaacaattcagtggaggaggaatagccttttcaataagtggtggagtgattaaaatccataggaggaaaaaccaaatgaaccttgacctaaacctcataccttacaggaaaattaactccartggatcatagatttaaatgtaaagctataaaaactttagaaacaggagaaaatcttcaggatctagagctaagcaaagaatttttagcatgtttggcagtcctgtggatctgtctcttgcctcaacactgtctggatggaacagatccgggggagactctctttcaaaaaaagtaataatttttagacttgacattaaaagcacaatctagaaaaggaaaaattgataagttgggctacattaatatttttaaaagttttgttctatgagagcctatgtgaagaggatgaaaagacaagc

SEQ ID NO: 81642 - DNA, 601 bp, Human
acacagaaatgtgacctgagtctggctctgctcaggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacgtaagtatggcaccctttacttcctctcctcccctgcacctgatactgggagcctggggyggccagggaaagccagggctgaggggaagggcccatgtgtgccagcccaggccctggaccaccatcttcacaatattcccttacccaaaaccttacctgtaagtctttatttgcttaaatttatttatttatttatttttatttttatttatttatttatttatttattttttgagatgtagtctctctgtcacccaggctggagtgcagtggcgtgatctcggctcactgcaacctccacctcccgggttcaagcgattctcctgcctcagccttccaagtagctaggactacaggcgc

SEQ ID NO: 81643 - DNA, 601 bp, Human
gcagtggctcatacctgtaatcccagcactttgggaggctgaggcaggtagatcacctgaggtcaggagtttgaaaccagcctggccaacatggtgaaaccccgcctgtaccaaaaaaatataaaaattagctgggcgtggtagtgcacacctataatcccagctactggggaggctgaggtggaaggatcgcttgaacccgggaggcagaggttgcagtgagctgagatcatgccactgcactccaacctgggtgatagtgagaccctgtcgcgaaaaaaaaaaaaaaaaaaaaaaaaargagtagcctggcaaaggagatagaaggtagctgaacattgaaatgagttttgaggggagactcccaactttttaggctggtggggggccgtgttgcttactggaacaaggaggaacagagactctataagcagccagctgggcaatgtgagagttgtcttgtaccaacaagggaatctgactgtaaccaccttgctttccctacagactttgagaagcccgagagcccccgagccgccagcagcagctccccaggatcaccagtggcctcaagccccagcaggctgagccccacccccga

SEQ ID NO: 81644 - DNA, 601 bp, Human; identical to SEQ ID NO: 19621

SEQ ID NO: 81645 - DNA, 601 bp, Human; identical to SEQ ID NO: 19622

SEQ ID NO: 81646 - DNA, 601 bp, Human; identical to SEQ ID NO: 19623

SEQ ID NO: 81647 - DNA, 601 bp, Human; identical to SEQ ID NO: 19624

SEQ ID NO: 81648 - DNA, 601 bp, Human; identical to SEQ ID NO: 19625

SEQ ID NO: 81649 - DNA, 601 bp, Human; identical to SEQ ID NO: 19626

SEQ ID NO: 81650 - DNA, 601 bp, Human; identical to SEQ ID NO: 19627

SEQ ID NO: 81651 - DNA, 601 bp, Human; identical to SEQ ID NO: 19628

SEQ ID NO: 81652 - DNA, 601 bp, Human; identical to SEQ ID NO: 19629

SEQ ID NO: 81653 - DNA, 601 bp, Human; identical to SEQ ID NO: 19630

SEQ ID NO: 81654 - DNA, 601 bp, Human; identical to SEQ ID NO: 19631

SEQ ID NO: 81655 - DNA, 601 bp, Human; identical to SEQ ID NO: 19632

SEQ ID NO: 81656 - DNA, 601 bp, Human; identical to SEQ ID NO: 19633

SEQ ID NO: 81657 - DNA, 601 bp, Human; identical to SEQ ID NO: 19634

SEQ ID NO: 81658 - DNA, 601 bp, Human; identical to SEQ ID NO: 19635

SEQ ID NO: 81659 - DNA, 601 bp, Human; identical to SEQ ID NO: 19636

SEQ ID NO: 81660 - DNA, 601 bp, Human; identical to SEQ ID NO: 19637

SEQ ID NO: 81661 - DNA, 601 bp, Human; identical to SEQ ID NO: 27506

SEQ ID NO: 81662 - DNA, 601 bp, Human; identical to SEQ ID NO: 27507

SEQ ID NO: 81663 - DNA, 601 bp, Human; identical to SEQ ID NO: 27508

SEQ ID NO: 81664 - DNA, 601 bp, Human; identical to SEQ ID NO: 27509

SEQ ID NO: 81665 - DNA, 601 bp, Human
tttgcaaatacacagtatcaaattattgacaatgttgtgacagacagtgaattcatttctagttttctgacttttactaagttactgtcagagtagatcttaaatccatattttattgattgacacttccctttaaactgtttattttaggttcttgcatacactgagggacttcacggaaaatggatgttcagcgagatacgagctgtattttcaagacgttaccttctacaaaacactgctttggaagtatttatggcaaaccgaagtaagtccccttaatattttgaaagaaaatgtrctcatatttacatattattcatttacatggtatgataatgtcttgatttttcctactgtatttctgatgtgctctagcttaaacaaacagaaattctttttaaaaaataaaaaaagaatgaatttgtttgaaatgttagccctaggtttctcatggataaagttatactgaaagctgatttttcatgaagattcattagctttacaaataaatcatgataggcacttgaagatgacttgtaaaattgatggctaacttatcctgcggttttctaaactctgttttttttcttcttaccac

SEQ ID NO: 81666 - DNA, 601 bp, Human
atctttacaagagatattctgccagagatattttgcaagatatctttgcaagagatattttgataatcttttgtgctatgtacaagacaatgcctattaagattccatgtgaatactcatgttaataatccatgagtaacagaaatagccttaagtctgttgttcccaaactaaacacgaaggagtcctgcgatatcacagtgaattctcaggggtgctgcaggtcattttttaattttttagggaaaaacagcaacatttgtcagataccacacaaactatttgctcgagttagttccamgtttcaacttagaatgattagatagggctgcatctttttcagtgacacctctgagaaactggtgtttggtggctactgtcttcaaaaacaagagccatatgaaaaatcagtgtggaacaggaaatgagtgtggtggtgtcagatctgattccaaggtttcagaagctgtgcagtttccaacagacatacacaccccattagtaaatgtggttatttaagaatgaaatataaatatttctctttaagtttatgagtattgtattttcaaatagctactcagttgttaagatgttaaatatt

SEQ ID NO: 81667 - DNA, 601 bp, Human
ttttcctgattggtggacagtgtgtatccattcatctcttcttatcaaatcacccttcagagttctcttatgatcctaaaataaagggtgctctaaagatgttaagttgtaccagtatcactttaacgaacacgggtcctaaaaataatcatactattttataacactgttttagggatacggttattgttcaggaagtatttatttcatttgattgattgaaacttaagatttatcatttctagataggatgttagtcttctttttgacaaatgtaatttcttaggtaatctaaagccargacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcgg

SEQ ID NO: 81668 - DNA, 601 bp, Human
ttatcatttctagataggatgttagtcttctttttgacaaatgtaatttcttaggtaatctaaagccaagacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaacccygtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaaaagaaacatttctttgttaataataagaactcagaaaaaatagtaaataatagtttatgactattgaataatttataatgtgccaaacattgttct

SEQ ID NO: 81669 - DNA, 601 bp, Human
tggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaraagaaacatttctttgttaataataagaactcagaaaaaatagtaaataatagtttatgactattgaataatttataatgtgccaaacattgttctaaggactttatatatatttgctcatttaatcctcacaatagccccatgagttaggttctgttcttatccccattttacagagatgaggtagagagtagctaaataacttggcccaagtcatagggctaataagtgacacagtcgggattcaaacctaggcagtttagctccagagtcttcattcagttactacagcgtactgtt

SEQ ID NO: 81670 - DNA, 601 bp, Human
attttgctgtcattaacattttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggag

SEQ ID NO: 81671 - DNA, 601 bp, Human
tttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagataggtagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgatta

SEQ ID NO: 81672 - DNA, 601 bp, Human
atattcatcttccaagataaattcttataagcatagttagcaaaataaagtgtatgtgtgtgtgtgtgtggagatagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcaytttttggatgatttaatgaacagtattttttttcatttcacaaaggtgttcagtaaaataattaaaggagtaatactaattcatgattaaaacatatcaatgcaaaaccccaaagtgccacttcatcactctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgcta

SEQ ID NO: 81673 - DNA, 601 bp, Human
tatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgattaaaacatatcaatgcaaaaccccaaagtgccacttcatcactctttttttccatktaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttccttttagcacttattttcaaaggacctctcaaagattattgaaagtgaattacaaaaaaaaatgcaggacagaataatagacatgaaatatggctattggcatcatt

SEQ ID NO: 81674 - DNA, 601 bp, Human
tcttctttgtatttttttcctaaaatagcattatttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacartacatttaaatactgtgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccaga

SEQ ID NO: 81675 - DNA, 601 bp, Human
tttcctaaaatagcattatttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacagtacatttaaatactktgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccagaaatagctctgtctag

SEQ ID NO: 81676 - DNA, 601 bp, Human
ttgtttaatctcatcattagtattattcaccatagacttaaacacaagcaggttcattgattgcttgagctacctagctgtagatgttttcttctcgtttaatgtagacattcacaatatcattctctctcatatatacctctacgcctttgcataatcctcatcttctaaagataatgttctgcagttttcctttacttgacttatatttgttcatcttctgaaatttgggtcattttattccatttttatcacatgcatatccattccatcaacaaacatttattgggcagatggcatrtgccaacacacagagattaaaacaaacaaacaaacaacccagccctgatatttatgagtttacagactggtggagaggcagagaagtaaacagcaatgtatatcaggtataatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttg

SEQ ID NO: 81677 - DNA, 601 bp, Human
aggttcattgattgcttgagctacctagctgtagatgttttcttctcgtttaatgtagacattcacaatatcattctctctcatatatacctctacgcctttgcataatcctcatcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgayatttatgagtttacagactggtggagaggcagagaagtaaacagcaatgtatatcaggtataatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaa

SEQ ID NO: 81678 - DNA, 601 bp, Human
attcacaatatcattctctctcatatatacctctacgcctttgcataatcctcatcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgatatttatgagtttacagactggtggagaggcagagaagtaaacagcaatgtatatcaggtrtaatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttgatgcttgcaattacagattttggttct

SEQ ID NO: 81679 - DNA, 601 bp, Human
ctacgcctttgcataatcctcatcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgatatttatgagtttacagactggtggagaggcagagaagtaaacagcaatgtatatcaggtataatagaggtctgtatgagaactgtggtgagrcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttgatgcttgcaattacagattttggttcttactcagattgtatttctttttttttctattt

SEQ ID NO: 81680 - DNA, 601 bp, Human
gaagtaaacagcaatgtatatcaggtataatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttgrtgcttgcaattacagattttggttcttactcagattgtatttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataa

SEQ ID NO: 81681 - DNA, 601 bp, Human
tatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttgatgcttgcaattacagattttggttcttactcagattgtakttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataattttgttcaacaaaagttttcttaggatcctgtttcttta

SEQ ID NO: 81682 - DNA, 601 bp, Human
ctttcagggcctctgactggcaaggctctgcttccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcmcttgaaatgcattgttatcagagttaaagatacggttcaataaataaaaagttattttcttctgaaattcagtagatgctttgtaaaaacagaaactatttcataagcattttgtgtatacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcata

SEQ ID NO: 81683 - DNA, 601 bp, Human
ccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatayggttcaataaataaaaagttattttcttctgaaattcagtagatgctttgtaaaaacagaaactatttcataagcattttgtgtatacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagta

SEQ ID NO: 81684 - DNA, 601 bp, Human
tgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatacggttcaataaataaaaagttattttcttctgaaattcagtagatgctttgtaaaaacagaaactatttcataagcattttgtgtatrcaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagtatatatagccagttaatgtttgtaagaaggtgaaactgattatcttgacttacatagtcagtttctaaatcttaccaattcttagcac

SEQ ID NO: 81685 - DNA, 601 bp, Human
ctagcataggcaaaatgaaatgggtatttgagaaacagcagatgtagagagagttttctcatatatcctaggctttaaagtcaaggttaaaaacctaaaattagtagaaaatatgatggcaaatcatttatgtgatatgttccttagatggtaagacatttatattgaccataaaatacacacattgtagggaaatataatactgaaaagaaagtcagttaattttaccaagtgtctgtctatatatgagagagaagatatggcccaaaagatggcaagaaaatggtgcataacggtaatragaaataaaaggcaaaatttttattagctcacctcatttgtccagaggaaactacagtgtgatactaaactgtttgaaattcagtgaagaactgggaactaagcccaaaaagctgctctatagtctaagcttacgccagaggcctgccttaaagtttatgtatgttagccatagtaaagcctcagcccattgacttggaatgtatctctgttttctatcagacttgattgtctgatttagcaatccacagaaagttgaaaggtatttgtgtatacatttggttttagggggcaggtttaa

SEQ ID NO: 81686 - DNA, 601 bp, Human
gccatttaccagctgtggagctttagacaagagtattagtttctctttgtcttaatttcctcacctatataatgagacatcaataataatagggttgttgtgtggagtggtggatgggttaataagcataaaggacttagaatagtgcagggacatcagtattagctaatgctatgtatatgacaataatagagtggtgaatcattgatataggccatatgctttgaattgtgtttcaaataatgatgatgaatatatgctactacatacatattggatgagaatatttgaatggcatgcmtgacttgccaaggttgaagtgtaattttggggtgtaaaacaaaaaccaaactaacttattgatgtgaggatgaaaactgtcaaactagttctttgacaaaatcttgtctgcatgtattttatttaacataaattgaatagccattacttagacattataaaatatatatacgataaaaattcagagtatagattctcaggtagcatattacaacctcgtacgatgactactattatggctattgtattatttttaaaacaaggaaggaagttctttttatttaaaatcaactgggatgtt

SEQ ID NO: 81687 - DNA, 601 bp, Human
gagtgaataaagcagacatactcccagccacttgaagggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggmaaaaatgagttaaaataaatgaggaagtcactgtttctacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttg

SEQ ID NO: 81688 - DNA, 601 bp, Human
ggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggaaaaaatgagttaaaataaatgaggaagtcactgtttytacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttggccaggctcgtcttgaactcctgaccttgtgatctac

SEQ ID NO: 81689 - DNA, 601 bp, Human
attttaatgtatgaaaatatatctttttatatgcctaatgggaaaatgacatttgaagtataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggastcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacagccttcatgaaattctgtgttgtatcagttgggaaacttctgaatgaaagtttcagaaaacacagctgaaagtggcttgaacaatagtgggaattgggagaaaaagtcaagaggttgtaact

SEQ ID NO: 81690 - DNA, 601 bp, Human
ataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggagtcctgatcccagtaataattcttagcagtgaataattctagaatttgtttcaataaacrtgtggtaccccaaatactttttatattccttactatatgaaagaattaagaaactatgaaatgtacaatgccaaaaaaataaatatttattttctttctttataccaccacattacacagccttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgc

SEQ ID NO: 81691 - DNA, 601 bp, Human
tggagagtttcttactcttcagaagctcaaggaaaaattgaaatacttgaatgatatgaccaagaacattctaaaagatctctaacaacaaaagtagttgtttctaaacaaacactgggagtcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacagscttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcaccta

SEQ ID NO: 81692 - DNA, 601 bp, Human
tgaaatacttgaatgatatgaccaagaacattctaaaagatctctaacaacaaaagtagttgtttctaaacaaacactgggagtcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacagccttcatgaaattctgtgttgtatcagttgggaaacttytgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtgg

SEQ ID NO: 81693 - DNA, 601 bp, Human
tgaaagaattaagaaactatgaaatgtacaatgccaaaaaaataaatatttattttctttctttataccaccacattacacagccttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagcaaatttccataattgtcatttgagagttcactatctttggtatgattgacaaaaacctactgaaggttatttgattcctctgatttattttttattctagtaagattaaaaattaatgccatttaataaaatatttttaattcaataaataattctgttttatcatc

SEQ ID NO: 81694 - DNA, 601 bp, Human
ttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagmaaatttccataattgtcatttgagagttcactatctttggtatgattgacaaaaacctactgaaggttatttgattcctctgatttattttttattctagtaagattaaaaattaatgccatttaataaaatatttttaattcaataaataattctgttttatcatctatttgagttatcaaattatcaaaactgtaacatcaaaacactaaggttatattaaatgtttattagaactttaggtgcacatttatttagactgaaatattttatatttataatattcttacttgttctttg

SEQ ID NO: 81695 - DNA, 601 bp, Human
atgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagattwcctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcat

SEQ ID NO: 81696 - DNA, 601 bp, Human
tgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagatttmctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcatc

SEQ ID NO: 81697 - DNA, 601 bp, Human
gggtgacagggagctttatagatttatacagaacttccaaagcagtcctaggctctgtttgcttatactaaatgtctctttatcctcttttcttgttccttcccacgtagccagctgaatcaccctttcagaaaaagagagggaaaaaaatcctatagagcctgttttgctttgaaaattttaggctgttaaagaagaaactgaaaacagcaggaacactgtttagtgtatgctcttagaagaatcctacctatggaaaggaaaagagagcctgctttatgcactttaatttcaccagccrcatgtcacctctgtgtctaaaccacagcattatcatgcaaaactaggccaaattcagtctcctttaacctttctttccagctgaaacagaatattaagcagttagaagtgatcttgaaactaatttgtagccccatcattatccttctacttaatacctggaaaacttctagaactaacacatgaagatttaagatgctctactgtttgtaggtgaaagtatttacttttcactaagatatataaaactaactttcttaggaactatcttgggataatgataataataatagccaatatt

SEQ ID NO: 81698 - DNA, 601 bp, Human
cacatgaagatttaagatgctctactgtttgtaggtgaaagtatttacttttcactaagatatataaaactaactttcttaggaactatcttgggataatgataataataatagccaatattttgcatgtgtttattatatgccaggcattgtgctaagcatcttacatggattttcttgctttaccctcacaacgctatgatgagttgcactggttatatagattgcattttcttccattcgttacctattatttctccataatacatagataggatattctttaaaaaaaaaaaaaaaagctagtgattaatttctcttctagatgccctctaccttttctaagtgccctggcagtttttatacactatcaaaaaaaaagaaaaacaaaagaaaaaaaacaaggaaagaaaaagaaaaaagaaaaactctccctattatccagtaagaatgagttcttttaaaatatcctgcacaatgctcagtcatgtcagatatgaggagaggagtcaaaagaaatgcggtcagtgagccattccacacctccaaagttttcagtcctatgtgggactagcattcctgtgaaagtgcctaaagctgg

SEQ ID NO: 81699 - DNA, 601 bp, Human
ccctaacacccccaccttttttttcatgatattgactcatttaagagagcatgccagttatcttatagaacataacaataacagccaatattttgcatgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgyggtggtgcaatcttggctcactacaacttccgcctccgagattcaggcaattctcctgcctcagcctcccaagtagctgagattacatgtgcccacctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatata

SEQ ID NO: 81700 - DNA, 601 bp, Human
catgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgcggtggtgcaatcttggctcactacaacttccgcctccgagattcaggcaattctcctgcctcagcctcccaagtagctgagattacatgtgcccrcctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatataaagttactatagttaatttaaatttatcaaagttaaaatgttcacatgtgaaatatatttctgggtcatataattctaaaagccgactaaaatta

SEQ ID NO: 81701 - DNA, 601 bp, Human
aatcagtctagaaaatggatgtgaagacaatatgttatacaaatatatagtatcatcagcagttgtaatagcagtagtgaactcttgaacattttatgtgtgcaggtttgagtattccttatccataatgcttgggaccagaagtgtttcagacttcagattgtttcagatttcagaatatttgcatatacacaatgagatagcttgggaacagatccaagcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacat

SEQ ID NO: 81702 - DNA, 601 bp, Human
gcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttaytgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttatttatataatttttgtggtcatttttacttactaaatttatatattttatacctgtcctaagaaaagggcttggtacaatatgcaggt

SEQ ID NO: 81703 - DNA, 601 bp, Human
atgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttmtttatataatttttgtggtcatttttacttactaaatttatatattttatacctgtcctaagaaaagggcttggtacaatatgcaggtttaaaagatagaaaaatattggtaaatcaaggctaagatgacagaaagaggaaacagcaaaatgaaactaaagaaaaagttagcatgcagaaatacacatcaaatacataccagaatgtttcaaggtacaatctaaggtattgcatctaaacagttgttttaaaaacaaaagaagtatgtatttcccattaaaaattttaaaaaataagcac

SEQ ID NO: 81704 - DNA, 601 bp, Human
tcagtaaactatcgcaaggagaaaaaaccaaacaccacatattctcactcataggtgggaattgaacaatgagaacacatggacacaggaaggggaacatcacactctggggactgttgtggggtggggggaggggggagggatagcatcgggagatatacctaatgctagatgatgagttagtgggtgcagcgcaccagcatggcacatgtatacatatgtaactaacctgcacaatgtgcacatgtaccctaaaacttaaagtataattaaaaaaaaaaaaaaagaaaagaaaaaaaaagaaaaatatactgagttagaaaaacatatctgaacatctagtaaagtataaaatatgtgggtaattttaaatgaaaaactcattactttcggccaggcatggtggctcacgcctattatcccagcactttgggaggcccaggcgggcgaatcatgaggtcaggagattgagaccatcctggataacacagtgaaaccccatctctactaaaaatacaaaaaattagctgggcatggtggcgggcgcctgtagtcgcagctactcgggaggctgaggcaggagaatggcgtgaacccagga

SEQ ID NO: 81705 - DNA, 601 bp, Human
cctctcctggtttgcctcctgtcatcctaactgttctgctcagtctcctgttcagattgtttttccttaatgttcctcttctacaggatttttctttatatttcagctgagctgtgtcattcagttacaagctagtgatttccagcttctctcttctttgcaaacatttctcatgggttcctgacccatatttccaagtgcctactagatatttctacctgaacatctcacagtaccataagcagcatttcaataaatgaactcctcatctccctcatgtacctgctgtggttaaatgccrtgattattcactcagctgcccaatctagaaattgggaagctttttcctagatattttctctgtctttccaacctcttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctc

SEQ ID NO: 81706 - DNA, 601 bp, Human
cttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaarcacattggtaaagcagagtatatgaaactgcatctcctgtcttcgaaaatattttttcccttcacctaaatgacagctctagtttgtaggtcttccttaggcattctctccattatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagt

SEQ ID NO: 81707 - DNA, 601 bp, Human
ttgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaaacacattggtaaagcagagtatatgaaactgcatctcctgtcttcgaaaatattttttcccttcacctaaatgacagctctagtttgtaggtcttccttaggcattctctccaytatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagtctggactaactagtcttttgagaaaacaaacccaaatcttacttttaaaaatgaactctgtaatgataaactaaaggaaaagacataaaactatttttagaccaaagttatta

SEQ ID NO: 81708 - DNA, 601 bp, Human
ttagtccacatggaactctcaaggggaccaccaaaactgttagcaaaggaaatttttggaaaacactgaaactagagattttcaccctgggaggccttttcataccacctcaggtcccgtcaatgacaatcattgccttagtgagccaccaccatggagggagcaggacacctcttgcaggtactttggggatgaggaaaaaggtcaggagtccttcctgagaaaatgttatcaactgggttgtttggagaattaaatgagagtatatatatgatagtattttgaaatacataaagtggtrttcactgtttttttacctaatcaagttagtctgaagccagatttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactacca

SEQ ID NO: 81709 - DNA, 601 bp, Human
ttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtgg

SEQ ID NO: 81710 - DNA, 601 bp, Human
catctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcrtttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattg

SEQ ID NO: 81711 - DNA, 601 bp, Human
gaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtrttttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattgtaatgtcctcactcccattccaaggagtttatgaaatagaaaatgcattaaaatttgggtcactaagaatttgttcacaaaaataaaatacacat

SEQ ID NO: 81712 - DNA, 601 bp, Human
aggttttctgctataggaacatgtactggatggcagacactatgttatccaaagacaatagtcacagaatgcaaaaaggtctagttcatctactgtcatttgtacttactttattcttcgttcaacagattatatattgagcaacttctatgtaccaggagttgttctaagtgttggagataaaacaatgaataaggtagatacggaacctactcatagtggggaatatagacagattaacaatcaattaaaaccagtgtgataaatgtttcagtgctgtttgaggaaacacagattgctrtttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttgcagatcattcagcctcttgtaaaacaaattaggtagtttagactctctcctaatcactcccaag

SEQ ID NO: 81713 - DNA, 601 bp, Human
ttaacaatcaattaaaaccagtgtgataaatgtttcagtgctgtttgaggaaacacagattgctatttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttscagatcattcagcctcttgtaaaacaaattaggtagtttagactctctcctaatcactcccaagagctattgaaggtttttaagcagggatttgcattttaaaaacattatcagaccataaggtagtactaatactttcgtagtctttcacaggtaatctaagatggacattctctacctaattccacactgcagtgatcagtatcagagtgatttttgtgatcagtatcagagtgatttttgtgatcagtatcagagtgatttttcttattgcaatgttagtgtatatatagccttaat

SEQ ID NO: 81714 - DNA, 601 bp, Human
tcatattaaaattatatggtacatctaaccttataggaaataattttgaacattatagaaaataactgaaaattctttcatattacccagtgaaggtgttttcgttatttcaaaaaattcctacctaatttagatcaaataatcaggagatgtgaaaagcctataaaatgcctttcctgctgttaactcaatatttggtccattccataaaacacagcaggaattggatttgaccttaatgtgtcatattgttatagcttgcctggcttggggtttgcgtagcctggggcaattaataaarcattaatgacaagacccatttaaaatgtaggcttttccgtatagccttagcttttacttgactgtgcctggggatactatgcaacaatacacattagattaaaccaacacacacacaatatccagaaacagccagagagcagagtaattttacagttggtactgcttaactattgttaaatacaaggatttgttattcatttatatgggctcctattttaaaaaagaaaaacattgtattcaaagcaataatatatatttgttctctcatttgtctcattttttttcctgataataaggt

SEQ ID NO: 81715 - DNA, 601 bp, Human
tatcattctaagacatactttcaggtccaatttctcagcagcttgaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagargctgattaacagaaatttatcaatgggaagagagtcagcagaacagcagttatcttaagcatgcaatctagtgtctaatgtgcctctgtaggagtacacttacacattataaaaataagcccatcctttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcaca

SEQ ID NO: 81716 - DNA, 601 bp, Human
gaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaasagcagttatcttaagcatgcaatctagtgtctaatgtgcctctgtaggagtacacttacacattataaaaataagcccatcctttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattt

SEQ ID NO: 81717 - DNA, 601 bp, Human
actataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaacagcagttatcttaagcatgcaatctagtgtctaatgtgcctctgtaggagtacacttacacattataaaaataagcccatcytttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgggagctgcaaggccacttcatgcctaggcccggaagtcacatcatgttacttccacagcgttgtattgctcaaa

SEQ ID NO: 81718 - DNA, 601 bp, Human
tcttaagcatgcaatctagtgtctaatgtgcctctgtaggagtacacttacacattataaaaataagcccatcctttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgrgagctgcaaggccacttcatgcctaggcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttg

SEQ ID NO: 81719 - DNA, 601 bp, Human
gcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgwtgtctacataagccccaggtacagataaggcacagcaattcctaatttggagacctgggagctagaaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattc

SEQ ID NO: 81720 - DNA, 601 bp, Human
ccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgttgtctacataagccccaggtacagataaggcacagcaattcctaatttggagacctgggagctaraaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttt

SEQ ID NO: 81721 - DNA, 601 bp, Human
acatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttttgtttccagaagaaataaacatggtttgcagctgagtatctttctctgcatgcttcctgaccatagaaagttagggccaaagcctcatattcccaagttggtasagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctgtggccatattttacttgtagcaccttcgaattgatctccatcctgaacctatgtctta

SEQ ID NO: 81722 - DNA, 601 bp, Human
ctgcatgcttcctgaccatagaaagttagggccaaagcctcatattcccaagttggtacagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctrtggccatattttacttgtagcaccttcgaattgatctccatcctgaacctatgtcttattttgagaatcttttgccaactgaagagagtgttctaggcccttctattgcttgaaatactgcttcaaaactgaacagtttcttcctgagttcatctctctcttgcatagcttatctcttttgcatagcttacaccattagatgaaaccattggtcactttcagcattctgcctggaaatcttctaagtcagaagcacatgcttattaggtacttgttctgtctttgaaattattgcagaag

SEQ ID NO: 81723 - DNA, 601 bp, Human
ccatctatgagaaaactctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccgtaacataggttcaagtagccctgaatatacactctgattagyagcaatcataaataggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattctt

SEQ ID NO: 81724 - DNA, 601 bp, Human
actctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccgtaacataggttcaagtagccctgaatatacactctgattagtagcaatcataaatrggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattcttttcctcatatttgc

SEQ ID NO: 81725 - DNA, 601 bp, Human
tgacatcaccaccatgttacatatcaataaactttttgtcaaaaggttaagaaacctgcccaagctagcaagaagtctggattggactcagacctgtttgattctgatgtatgtaaggtagcatttccctggtagaagaagggacaatcccaatgctgctgcctgcccagcttccccctttatcttcaactcactggtagccatgaggttcctcttctttaagaaacacactttgagccgcgtacggtggttcatgcctgtaatcacagcacttggaaaggcagaggtggacagatcactygagatcaagagttcgacactagcctggccaacatggcaaaaccccagctgtactaaaaatacaaaaattagtcagccatcatggcgcacacctgtaatcccagctactcgggatgctgaggctcaagaatcgcttgaacctgggaggcagaggttgtagtgagccgagatggcaccattgcactccagcctgggtgacagagcaaaactgcatctcaacaacaaaaaaaaaaagaaacacactttgaaaaccagggcctgcaaagtttttaatcaacatttcaatgcctgaaatttagga

SEQ ID NO: 81726 - DNA, 601 bp, Human
tgggaggctgaggcagaagaatcgcttgaacctgggaggtggaggttgcaatgagctgagatcatgccattggactccagcctgggtggcagagcaggactccatcgcaaaaaaaaaaaaaaagaaaaaaaaaaaaagaatgactggattgttactttaaaaggcagaatacagaatataggagcaggaaacctggatttaaagtatctgggtttgatttttggccttactaccaatttgcagtgcagccattagcaaattacccacccaatctttacctcagtgttcatgtctataaagygggaataatgagaacacctacttcacaaactttttgtgaagattaagaaaatatatgtaaagcacttagaacagtgccaagacatagaaaggtaccaaaataaatgttacctgctggtttaaaacagaatgaccacaggtaacatttaagttgattcctggccttggagcacaaatgtagtaattgccatcttcttgcacataaccagttaaatctcagagatgaaacgctcatattctttggtttatatttttgaaacaacaaatcttttcaataatggaattgtgaatataaattata

SEQ ID NO: 81727 - DNA, 601 bp, Human
gaatggagccaaaaaaaccatccttacttagaagggtgtcctgaaggccctggtaacacgacttctttctatgactagccccagttagggcctccttgaatgatcctactggagtattcttcctcctgcccttctaaagaaccatcaagacagatctttctaggccttccttgttctttggtggaggccagctgttagtgcccttctttctagagtgcctaaatgaaaatgaaattagtcttctgccacttttgcagtttgagaacaattctgatggcaactttaaaatcaactttttctrtatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgactatctgtgtattccccagatttctagtcttattaaaataacttcatccaatatctttaatagcttaatatttaatgagcacctgctgcgtgcaaagtatagcactgagagctac

SEQ ID NO: 81728 - DNA, 601 bp, Human
ccagctgttagtgcccttctttctagagtgcctaaatgaaaatgaaattagtcttctgccacttttgcagtttgagaacaattctgatggcaactttaaaatcaactttttctatatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgacyatctgtgtattccccagatttctagtcttattaaaataacttcatccaatatctttaatagcttaatatttaatgagcacctgctgcgtgcaaagtatagcactgagagctacgaaggatccaacaaaacataaacctcacaaaataggctcaaaactttgcgtttgcccagattttattcatactaaaattgcattttcccaaattttattcacattaataaatatgacatcctatgtttcttgcgcctttgtgaatctaatttaatgactttcagtgaaattgcattgtagtggtaag

SEQ ID NO: 81729 - DNA, 601 bp, Human
tgacatcctatgtttcttgcgcctttgtgaatctaatttaatgactttcagtgaaattgcattgtagtggtaagtaggttaataatgaccacatattttatacaggaaagaatgggaaataatatatgaaaaacattatagagtgccaagatggtataagataaattaagactattttagttgtttaaataaaactaaatatattttgctatgtacatgtagatatatacgttcctctctgccctcaaggaagcttctgtagcctcgttatagagatagggcatgagcacaaataactgaygaaaggcagtaagggaaacacctgatttatgtgagtctagtacatataaatcacactcccaaccgagcagctgcacaagcttacgttccttcccactttggaccctttagggtgttattgctattgtgtcacatgaagaccaggtcatatgcaaatagcaatagtctttgccttctctgcgccttttactaattcctcatgttttcccaaagagtgagagtaagagcagaagaaactatatattttacattcatacattgaagtcataagataataatatgcatttctgattggatgcca

SEQ ID NO: 81730 - DNA, 601 bp, Human
ataatatgcatttctgattggatgccaatacatgagaacagcagtgattctttacttctactctcctgtcagcgatcaaaccaaactgctccttccgtgactgataaacactgtcatgtttgcccagcctggaaatcaaactcatgatagtcattgctgatagaatagtcactgctgaagtgccctttagcctgtcttatccttcaattaaactgtatgatttttggcaaatgaacatgtgttttctacagtatggtttttctttcagcctcttctccatttccccgttcatattggagtyattgaaaaattatattaatttgtattaattccactagaattctcttttcctttttcgttgtggccttgaggtcttgtacatagtttattgttgatacacatttggcccctagtgtgagccatctaattccctctctttagctctgttgtagatttcccctctttgataaagttccacaatagggcccctttctctccacacttagcagttgcccttctctctttctcctccctatacatgcatatacaccacatcttcccattctccaatctctcctttactttgtcacccagtgtcttg

SEQ ID NO: 81731 - DNA, 601 bp, Human
ccacatcttcccattctccaatctctcctttactttgtcacccagtgtcttgctataaaacaaatttgactgtgttaaaaactcttttttaaaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttakccatgctccaactccaatggcccatctccaatgaagtctctcctgacttgcccagaatcccctgctctttcctccctgctcccttcttcctcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaa

SEQ ID NO: 81732 - DNA, 601 bp, Human
aaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttagccatgctccaactccaatggcccatctccaatgaagtctctcctgacttgcccagaatcccctgctctttcctccctgctcccttcttccwcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaat

SEQ ID NO: 81733 - DNA, 601 bp, Human
tgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagygttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagca

SEQ ID NO: 81734 - DNA, 601 bp, Human
gtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagtgttactaaaatgaaygcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagcagtttgttttaatttt

SEQ ID NO: 81735 - DNA, 601 bp, Human
gtgttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagyagtttgttttaattttctcccaattactttttaaaaaacaacaaaaactttcagggtattaaaatcagttcatttctacatcagatttattctaaagtaacagaaacctcaaattagatgctgtacatcacacacaagttctccttgaatccagttgtttatgctacagttacatacaagtaacacaagttgtctttgcatccaatttattgagaacctgtcatttctatggcatgcattaaatatttaaaactgtttatcatattgtgtatcatctcttttattgtgttcagtgattga

SEQ ID NO: 81736 - DNA, 601 bp, Human
agggagttaacatattctgtagttttgttttgtcctgttctttactataatattaccaattatacttaacatctataaatacaagcttaaaattttaaatgaaaaagaaaacattttactgttgtcttgacagcattccttattgtagagtggattttccgttcatgaggactaataaagcaatggtaattcagttatgtttgctcctttaggagaagacaatcagatgagcatctgttgactaatataatgtattctaaagtgcttaaaataaatgcctatttcttagttttatctactractaaatctgaacgcttttttcacttataaaaacactcagaacagaaaaaaatttatttagaacatatttatatgtgcgatatttatgctgtgaaacataccttatggtgtaaacattctgaaatagaaaacatctttttttgttttgttttacagacagtgtttcactctgttgcccaggctggagtgaagtggtgcaatcatagcacactaaagcctcaaactcctgggctcaagtagtcctcccacctcagcctcttgagtagctggggttataggcaaatgccaccatgccaagtt

SEQ ID NO: 81737 - DNA, 601 bp, Human
acttctcaatctgttaaattggcactttcagatatatgcagttatttcatactattcccttgaacaatagcttatttcttcaatttatatttttaatgtgaatgacttatatttcagtaatatatacttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagakctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgatttttttttaacatttattttac

SEQ ID NO: 81738 - DNA, 601 bp, Human
acttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaacyagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgatttttttttaacatttattttacagataagaaatatgaaggccagacatgtttcataatttatccatggcagagcccagattcaagtacagaaaagttttaactcctaagttatactctttccagtatgccagctacctctgatatta

SEQ ID NO: 81739 - DNA, 601 bp, Human
atatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcargcattaagcaaggcacttgatttttttttaacatttattttacagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgc

SEQ ID NO: 81740 - DNA, 601 bp, Human
acagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgcaagtatactaagcttaaatatgcattaaagaaaaatagagtrgttatctttattatccactggacatttcacatttattaatttgctaatgtttactgataatgtaccaggaaatgtatatgacattttttagacttctaaacatgcagtaatgcagactggatgagcaggaggccactgttgtttcccagtcccaggactaggccacatttcctgctagaagagtactattttcagtggtacccattccattcagtgtacagataactttaggaaagggatttgccttcttaataaaagactgaaagtttgagaagaaagttttaggatgagcgaagattt

SEQ ID NO: 81741 - DNA, 601 bp, Human
acttaattataatacaggtaaatacttctccagatagagaaagcctgcgcagaatgctgtttggaaataggaacacagctagtcagtggtcttggtgagaagctgcctgctctgtaaatgagccgaagtcataacaaagataggtggaagtaaaggtcctcagtgatatctcttcttaggagtacgtctgcactgatgcttccaaatgcagacataggaaacagtggactaagtgattggtcaaatgcctccagattcgtccactgaaaaataatttgtttgctatagaaattggtccccrcagtttttcctcctttttgtcttcctctctgctcatagctcacgctgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactc

SEQ ID NO: 81742 - DNA, 601 bp, Human
ctgatgcttccaaatgcagacataggaaacagtggactaagtgattggtcaaatgcctccagattcgtccactgaaaaataatttgtttgctatagaaattggtccccacagtttttcctcctttttgtcttcctctctgctcatagctcacgctgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagttt

SEQ ID NO: 81743 - DNA, 601 bp, Human
ataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagtttgaaacctgaaactatcaaacatctaaaagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaag

SEQ ID NO: 81744 - DNA, 601 bp, Human
aagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagygaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaat

SEQ ID NO: 81745 - DNA, 601 bp, Human
agcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaarttaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaacta

SEQ ID NO: 81746 - DNA, 601 bp, Human
aaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggraaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtact

SEQ ID NO: 81747 - DNA, 601 bp, Human
aaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctrctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatg

SEQ ID NO: 81748 - DNA, 601 bp, Human
cagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaakggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaag

SEQ ID NO: 81749 - DNA, 601 bp, Human
gttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaayggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagtatgta

SEQ ID NO: 81750 - DNA, 601 bp, Human
caaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagatyccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagtatgtattggtactttgcccaactttttacataatactaccacattgtgtggaatatcacattttgttcacccattcatcagttgatgaacatttgatttgtttctactttttggcaattttgagtaatgctgctatgaacagtcat

SEQ ID NO: 81751 - DNA, 601 bp, Human
cattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacsgcgcctggcctacaattttaatatatattccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattat

SEQ ID NO: 81752 - DNA, 601 bp, Human
ttccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattartgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgt

SEQ ID NO: 81753 - DNA, 601 bp, Human
tattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattaatgttggtataagctaaacaagcaagacctacctatatctgyagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgtggtaagaacatttaaaatatattttaaaaatatatatattt

SEQ ID NO: 81754 - DNA, 601 bp, Human
tataccccaaattttttgaatgtaggaaaagctaataattattgttgatgagaaacctttaaataattaatgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatsttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacat

SEQ ID NO: 81755 - DNA, 601 bp, Human
aattaataattgtttatatttatggggtatactgtgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcwctacttctatgagtttgacttttttagattccatacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatt

SEQ ID NO: 81756 - DNA, 601 bp, Human
tgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccayacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggc

SEQ ID NO: 81757 - DNA, 601 bp, Human
ttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacataagtgagatcatacattatttgtatctctgtgcctggcctattttatttaacataatatcctccaggttcatccatgttgccacaaatgacagaatttcctgttatttmttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggctggattatatggtaattctatttttagttgtttttgtttgtttgtttgtttgtttgtttgttttgagacagtgtctcactcttgcccagactgaagtgcagtggtgcaatcag

SEQ ID NO: 81758 - DNA, 601 bp, Human
ggctttaacttgcatttttctgatgattagagatgttgaacattttctcatatgtccattggccatttgtatgtcttcttttgagaaatatttatttaaattctttgcccatttttaataggattatttgtttccttgttgagtagtttcggttccttgtattatggttatctttctaaaatttattactactttgttccctgcccttttatacaaggaatgatacttcattttttacttaaaaaagtcaagtttatcatcctgagtacccattgttattccatgaagtgatataattccrtatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaacc

SEQ ID NO: 81759 - DNA, 601 bp, Human
tgcatcattgttttaatccttaaaaaatcactttcagaggccaaggcagatcgatcgcttgagaccaggagttcaaggaccagcctgggcaacatgttgaaaccccatctctactaaaaatacaaaaaaaaaaaaaacaaaaaaaaattaacaaggcatggtggtacatagtcccagttactcgggaggctgagtgagagaatcacttgagcccaggtggacagtgaggcaacatcacaccattgcactccagcctaggtgacagaataagaccctgtctcaaaaaaaaaaaaaaaaaaaattagctgaggagttattgacctgaaacccattgaggtaaaaatatattttttttgagacagagtcttactctgttgccctggctggagtgcagtggcacgatctcagctcactgcaacctccgcctcctgggttcaagtgattctcctgcctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaa

SEQ ID NO: 81760 - DNA, 601 bp, Human
cctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaagtgctgggattacaggcctgagccaccatgctcggccccattgaggtaaatttacatgccaaataccaccaccttatcaaggtgtcagtgttcttattcacagtctccaggataggtaagtggtggtggcaggcaagaggagccgtggargagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtgccagctctctctgcccatctggtatgagaggaagtgtgtcctccttcaattctacaaatggaagaaatgatattcatttacattctaa

SEQ ID NO: 81761 - DNA, 601 bp, Human
aataccaccaccttatcaaggtgtcagtgttcttattcacagtctccaggataggtaagtggtggtggcaggcaagaggagccgtggaggagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtrccagctctctctgcccatctggtatgagaggaagtgtgtcctccttcaattctacaaatggaagaaatgatattcatttacattctaagctttgtagtcatgggattttagaactggaatacacctttatttgaatgaggagtctgaggcctaggaaggcaaagtggttcatggaaactctgaacccaagtgcttttctaactaaccatgcttggtgtcacaagttggaactctgaatgtagtgtccccttgttccgtcttaaagtctgtaaaattccacctgtattttgaattaaattt

SEQ ID NO: 81762 - DNA, 601 bp, Human
acagattattcattgaaaggaatagcctgaaaaattgtataatactataaagacaatttaaactctgaagtaggttttccctcttactgtaagagagaataaaacacatgaatacaaattctgagtaacaatttttaaaatttataattgctcagagtacttatattgcacataaattaaatataacaaataatttactcctgatactaatatgaccagtttaagaactgacttctgtttatatatacttcttacctgttataacttgtctttttaacatctaaagtgctgataagcagaytttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgaaagaag

SEQ ID NO: 81763 - DNA, 601 bp, Human
gcagactttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgaragaagcaaggcactgcagtttccctatgttctaaaccaaattcctgttatttcatcataggaattaatggatctggtaagacttgtgaactgaaactttattctatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacagaatagaaaggg

SEQ ID NO: 81764 - DNA, 601 bp, Human
taaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgaaagaagcaaggcactgcagtttccctatgttctaaaccaaattcctgttatttcatcataggaattaatggatctggtaagacttgtgaactgaaactttattcyatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacagaatagaaagggaaagctaccttgtgtatcaacaaaaagctgtatccataacagctatagcagccattcttagttgcttcagaattagagctaaaggaaaagcccacactgctgcc

SEQ ID NO: 81765 - DNA, 601 bp, Human
atgaaggaatgaaagaagcaaggcactgcagtttccctatgttctaaaccaaattcctgttatttcatcataggaattaatggatctggtaagacttgtgaactgaaactttattctatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacrgaatagaaagggaaagctaccttgtgtatcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcgtgattctgcagctgctcgtctctcagtgtctcctgtgctgcttcaacttgaagttttccttcatagcacctttttcatagtttctgttgctccaactcctggtcggttttctcatcctactacta

SEQ ID NO: 81766 - DNA, 601 bp, Human
cagtttccctatgttctaaaccaaattcctgttatttcatcataggaattaatggatctggtaagacttgtgaactgaaactttattctatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacagaatagaaagggaaagctaccttgtgtrtcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcgtgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcaga

SEQ ID NO: 81767 - DNA, 601 bp, Human
tctgtgttctctgcatcacctggaagcagtgccgggtgaaatggatcacgtgtaggagtgcctcacttgaaaagtgcttattgtttctgtgttgtgcttctgggttttccttgaaggaagcctacagaatagaaagggaaagctaccttgtgtatcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcrtgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattt

SEQ ID NO: 81768 - DNA, 601 bp, Human
aaagacatctcgtgaaatgtggctgcgtgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactmatataaaatatcaagtatttaaattttccataaattccttgaatataggctgtattttttatgttgttttgtaactttaaaagtttctaactttatattggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtat

SEQ ID NO: 81769 - DNA, 601 bp, Human
tttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattttccataaattccttgaatataggctgtattttttatgttgttttgtaactttaaaagtttctaactttatrttggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtatggattagtattctgtacctatgagtattccctccttctttcaaactgtcattaagaaattcaaggcaaagatgacaaaatattataaaaagtgatat

SEQ ID NO: 81770 - DNA, 601 bp, Human
ctctaagtgaagttagagtagagaaattccttcgttcattccgtaattatgaaggggctatcatgcacttcatcctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaatyttttaaaagtgaaatatctagtatcttagaaggtgaccggtggtagaaaataccactgcaagaaaaggagactgtgagtacctgcaggggagagaggtcaggacagcctccctatgaagggagattagaggtaggcctggaggagcagagggagggagccaagtgactctattggggaaagagcatggtgggcaaagggaacattagagcaaaggccttatggcagggatgtggttggcaaggaggccagtgggccaggaaagggtgggcaagtgggcacacagtaggacaagaggactg

SEQ ID NO: 81771 - DNA, 601 bp, Human
cctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaattttttaaaagtgaaatatctagtatcttagaaggtgaccggtggtagaaaataccactgcaagaaaaggagacygtgagtacctgcaggggagagaggtcaggacagcctccctatgaagggagattagaggtaggcctggaggagcagagggagggagccaagtgactctattggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtactttcctttttaccctgagtaaaa

SEQ ID NO: 81772 - DNA, 601 bp, Human
ccactgcaagaaaaggagactgtgagtacctgcaggggagagaggtcaggacagcctccctatgaagggagattagaggtaggcctggaggagcagagggagggagccaagtgactctattggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtacttgcctttttaccctgagtaaaatgtaaagtccttgcaatcttttgagtggaagtgtgactgatcttccttatgttttgaagggatcactctggctgcagtgttgggaatgaatgattctgcaagggtagaatcagggagatctgctagaaggtaatttgagagatgatggtggcttggaccaggggtagcagtaaaagtagtaagaaattattgattctgggtgtattttaaaatttgagcctatagtctccctgggacttcctaccagtggccattttccctcaggtatctctagtcttac

SEQ ID NO: 81773 - DNA, 601 bp, Human
caatcctcccccactacacatacaccctactccccatcctgcttttctgtttccttcgcacttgtcacctgctgacacaccctgtatcttactaattatgttagtttttgttggtctcctcccagtacaatgtaaactctcttgcagggactttgggtttttttgttcactgctataatcttacaatctagaagagggtctgtcacaaagcagatggccaatcaatatttgctgagtgaatgaatgagcttcttccccagccccgccctcattactgacatttcctttattccttcctcttgtgatcatcacatcttttccactgctttaattaataaacctataaatatttattaaacagttattatccaatgataggttaagagttgtgggaaatgcaagataagaattagataaagtccctatcttcaaaaggcttacattctaattgaggatatagtattaactttggaaacaatgaagtgctaattggcaatcatcccattcatttgtacagtacctcacagtttgttgtaaaatgatttcacaagtaaatttgcatgtgttatcttactctattaagtaacaagaggatactgat

SEQ ID NO: 81774 - DNA, 601 bp, Human
aaatattactaaataattagactgacattttttcttaattgaatagttatagagaattgacaaaatcatttatacaaattgaccaaactaatatagacataatacagaattttaaccatctcttctttcagactcatttcctgtgttctactctgaactgttatttcaagatcgatgagatagacaatatagaaattctgtttgcctttagtatggaaactgttctttcataaaatgtcattgtttacattgctgaatgagaaacatccacactaattggtgtagatgaaatacaaaaaawtttgaaaggagtaaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacaaagctagatgtacagctct

SEQ ID NO: 81775 - DNA, 601 bp, Human
ataaaatgtcattgtttacattgctgaatgagaaacatccacactaattggtgtagatgaaatacaaaaaattttgaaaggagtaaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgacmgccgtaatttagaaaattgtcttacatggctctgcaatagctgaaatttacaaagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtat

SEQ ID NO: 81776 - DNA, 601 bp, Human
gtagatgaaatacaaaaaattttgaaaggagtaaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacraagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatc

SEQ ID NO: 81777 - DNA, 601 bp, Human
gctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatccamaattgcccagtgattcccaaactgtgtaatagctgagttaattcatagtggaagaaagatattcccttctagtcatctcagaggtaagctggaggacttcaggcaggaaaataaatgtatatcagagtttctcataaaattgcttaatttcaaactaatatttaaaaatgagaaatgaaactgtaacatggtattaaaaaaggtaatttaaattatttttcttttaaacatgagtgtgttttaataagaaatttatttatgttaaatcatattatgtacctaatggagccaagagaaagt

SEQ ID NO: 81778 - DNA, 601 bp, Human
ctatatacaacccctatgagtagaccatgtgggaggcacaatacctttttttaaaacattcttgttgagttcctggaggtcttgtactgctgtgttgcgacttgagagagttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccawctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgt

SEQ ID NO: 81779 - DNA, 601 bp, Human
ttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccatctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatca

SEQ ID NO: 81780 - DNA, 601 bp, Human
gtaaaatgaaaatgacgacgcgagcacgggtactcaacgcgcttcatctgtaatccccacactttgggagaccgaggcgggtggatcactaggtcaggagttcaagacctgtctgcctcagagtatgattatattgtatgccataggcaacaaaaatggatagaaagatgggaatgatattataagttgtatcacagctcaaccattagtatttgagtgacattaagtcagtcacttgaattttatgtacctgtattttctcacctaaaaaattgatgacagagatgatacctaattcatrggagaaaaatatgtgaaaatacttaaactataaagcactacacaggcattattacctaaaggcataattaaatgaagttatcttagaagaacttttgttttaataatttcattatatatgacaccaaaactatcaatttaattttaaaaaatctgttagcaacagagaaaataagttaatttgtttttaatattatttagtaaaaagaagcagttgtggcttttaaatttattttcaatactgtctccaaaattttataaagatggcctaattgcagcccacttattgcctgtaacattc

SEQ ID NO: 81781 - DNA, 601 bp, Human
ctttattatcctttatatttttaaaagttttacattaggccaggcgctgtggctcatgcctgtaatcccagcactttggaaagccgaggcaggcagatcacgaggtcaggagattgagactatcctggctaacacggtgaaaccccatctctactaaaaatacaaaaaatagctgggcgtggtggcgggcacctgtagtcccagctactcgggaggctgaggcaggagaatggtgtgaacccgggaggcgcagcttgtagtgagccaagatcataccactgcactccagcctgggcgacaragtgagactatctgaaaaaaaagttttactttagtgtcattagttttgtattcatattatcaaatgaattagcaacactattactggcattaaagttgtactggttcagcaagagaaaaaaattgagtcagtatttcaacagaagctgtaagcatataccagacaagttattaacaagatactaagttctgaacttgtcataatacttgtcatcattctatagttgacgttgccagactgaaaatgatttcaatggctcctttttaacggtgagaggtatgcacataagtctatcataaa

SEQ ID NO: 81782 - DNA, 601 bp, Human
aatttaggtctatcttacctgctcataattactgcagtacttcactaggccatggtcatcaatcgtccactagaaaagcataaataatgcagctagtcaaagttggatgtatgtcatttatgtgacttgtgcttctttcttcgctttgtgttatttttattgtgtggtgttgagaagtgctaattattgattttcagaaattaacagcaagtactttcacaagcatctaaagccatattttactcaagggaagaagggtgaaaattgcagcctgctgtttataatagaaatagctggaagrgatttccttatcttctattaacatagatttcacttctataacacagttgttacctcagcataaattaacaattattcaaaacatattgcatacttcaatttgttgaaatagatattactcaatctaagtacctagacatttcagttagatatttagaactcatttttaaacattttaaacatattgataatgagcctatttaaagccatttgaagtctcagtacagtatatctaaattactgttgcccatttatgtcaaaatcaagaatattttgttctgctgaatacgtccaataatac

SEQ ID NO: 81783 - DNA, 601 bp, Human
aatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaartagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcacttt

SEQ ID NO: 81784 - DNA, 601 bp, Human
ttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcactttgggaggctgaggcaggyggatcacaaggtcagggatttgaaaccagcttggccaatatggtgaaactccgtctctactaaaaatacaaaaattagccgggcatggtggcaggcacctgtagtcccagctactcgggaggctgaggcaggagaatcacttgaacccgggaggcggaggttgcagtgagctgagattgcgccactgcactccagcctgggttacagagcaagactccatctcaaaaaagaaaaaaaaaaaaagttgaaagcaacccaagtgtccgtggatagatgaatggataaacaaaatgtggggtg

SEQ ID NO: 81785 - DNA, 601 bp, Human
agttgaaagcaacccaagtgtccgtggatagatgaatggataaacaaaatgtggggtggtgtatgtgtgtgtaatgcattattagtcaaccttaaaaaggaaggaaattctgacacatgctacaacatggatgaaccttaaggacattaatactaagtgaaacaagccagtcacaaaaagacaaatcctgtatgattccacttctatgaggtatcttaacgagtcaaaatcatagagaaagaaagtggaatagtgacccccagggactagagggagtggcgagtttttgtttaataaatakagcgttttagttttagaagatgaaaagagttctggagattggttacacaatagtgtgaatgtacttaacactactgaactgtactcttaaaaatggttaagatggtaaattttgtgttatatatattctaccacaattaactttttttaaaggataatgaagagagtttaataatggttctatttacaaaggtatagacatggtaaagtggatgaacaagggaaagcgacaaggaaagggagccattcccagaatctggcaataaaagtgctcacccaacaagagctgtggccttaggta

SEQ ID NO: 81786 - DNA, 601 bp, Human
ttaccttagtaggaagtcttttatatgaataagcaaatgtgcaacacataagcacacattatatttatcgatttccttttctgaggattcaattccaggtatgtatctttattcatagaggaggtagaacttccttggaaggaaagccaaaaaggaaagaaaacaattaagagatacggaggtcaaagaaagaaggcatgtgtcacatcatagctaacacacatgcccctttgtgcacactttagaggacaccttctctaaatggatgaattacaaaaggcactcctttctctggctctcmaggtagattctattacttatttgccttccaactgggcatctttgtacagggcataaacagcatacccatgcacggtggccctgacctatgagaaagaagaaagactcaagagaacttgttaagtaaggaaaaaggggactcccatgaagatgtcataatttcgtaacttagtaggtgggtcctgcagaattgtataaaggagagcctcatcagactaaggaatgggataatcaggaagtagggaggggacaaaagagaaagtgtccctaatcgaaacttttccttaatgggagctctata

SEQ ID NO: 81787 - DNA, 601 bp, Human
tggcagtaaaactaaacttactcctaccctatgactcaccaatcccatatctaggtatagaccctccaaaaactggctgctaacctccatcaaaagacatgtacaagaatcttctaagcaactttattcacagtaacctgaaactgttaacaacccaaatatccatcaacagaattgataaattgtgttaggttaatacaggggaatactatacagcaaaagaaaaatgaacaaactaccgatacatacaacaaggttgaatcttgcagacataaagttgatcaaaaaaggcagaaacagraaatatgtagtgtataactcaatttatcaaaaattcaagaataaaaaataattgatgataaacatcagaataattattagcttgacagggtgatggggctagatagggggaataattggctggggaggcacacaaggttaccagtatctatgtattctctcatgtacccaccacccagaccaagatatggaaccttctagttccattccaaagtcctctgtcttaatgtagatggtggttagaagaactgaaaaaatgtatatacatacatatatacattcatcaagctgtacacttaag

SEQ ID NO: 81788 - DNA, 601 bp, Human
ttttttaatgacatttctggataatatagaaggaattcatctcacagttccagtagtttctttttttttttaacttgatatatttggaaatttttaagggaaaatttctatatggtagaaaaccttttcatgctgtggacaagctaattcttacttaatcttcaaacctgagctctgtcctttttccaaaagtctctttcctaagaacctattccccttcccctctgtcactcgtctgggctcccagggcagcctgggcttgtctcccctgtgtcctgctccctaccatgtgcactgacayactcatcgtctttattttgggggctgctaacttcctgaggtcagcctggtatctgactttgtatcccttggcatagagtaagcattcaacaaatgtctgttaattgtttttgtggtattgaattgtaaaagtaaaaaattctgaagtgcttttctttttctagaccaggtttcagttttatacaaatgccctgcttctgtattcaccaaatatttttagaatctctgttaagactaagtcaccatcctgacctgcagagattcagtctgaacaaacagacatacataaataattgtgtgt

SEQ ID NO: 81789 - DNA, 601 bp, Human
tgaacaaacagacatacataaataattgtgtgttaaaatctatagtaaaggagaaaaatgtgctgtgagaatatgcagggcattcattatgatttagaaggatttagatccttgcccaaggaggtgaaggatttagatccttgcccaaggttagcattcggggaggattttctcctacacagggagtagctctcagaacaactacttcattgtaacaattcatgggttgcagaatgagttctgcgtgtcaccaggcaaccctcccattcacaggacctgcacacttgacaagaaagtcatygatgacccccttaaagtgggaaaggacagaaaatcttacatggggagcaggtgaagaaagatagtaggtgctcactctcccctcaaacgttttagtaatgacaagaagtagaacttaaaggagacagcatgcttttcaagatcagaaagatctgtacatttttaaatcagagggtaaggaattactggaaggcaggactaccagatagctaaaaggtaaatattggactgagatcctttgggtcatgaaggcatgtaaagtagatcacaaggaagagggagtcagtatagtctcaaaaga

SEQ ID NO: 81790 - DNA, 601 bp, Human
gttaatactttcctttaagaaacaaaactagagtcaagcaaagcatgtttgttgactaattccttcaataaacatttaaaggctccctactaagtgcaagacactgatctagagattaaaacatgtttaattttacccccggctcctcgcccccacttgtgtcctttttctggggaagtaaaaacaggagtagtagtatctgttgttagagagacgtttagctgttcatgatacatgaagctaggtattaagcacttgctaaccagggcagcgttaacaataaaattaccacttttctttscaaataattctcaagagttagttattaaaaatgtgaacctaaccagaaatggtctcttcccccttttataatcataaatcttgcactggggagacaaaagtaggatgtaaatgcatcatatgtgaataaaatttagttaaatagtcacacttgtgagtagacaccatgcaaataaatgtatacataaaaattggacagcacttaaagagatttaataattcatcccattgcctctgcagataaaagaaccaaagtcccatttacgcgatggctaaaatatggcagataatgatgcattca

SEQ ID NO: 81791 - DNA, 601 bp, Human
ctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgamttttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaagg

SEQ ID NO: 81792 - DNA, 601 bp, Human
ttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggacyttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgattt

SEQ ID NO: 81793 - DNA, 601 bp, Human
ggcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatctkcaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttcttt

SEQ ID NO: 81794 - DNA, 601 bp, Human
gcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatcttyaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttcttta

SEQ ID NO: 81795 - DNA, 601 bp, Human
aattttagagtaaagagctctggaatatggtccataatatatgtgtaaacaaatgtataagctgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataattgctttttgttgttgttgttttgaaacagaatctcactgtcacccaggctggagtgcagtggcrcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaat

SEQ ID NO: 81796 - DNA, 601 bp, Human
atatggtccataatatatgtgtaaacaaatgtataagctgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataattgctttttgttgttgttgttttgaaacagaatctcactgtcacccaggctggagtgcagtggcgcaatctcagctcactgcaaccttygcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcact

SEQ ID NO: 81797 - DNA, 601 bp, Human
ctgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataattgctttttgttgttgttgttttgaaacagaatctcactgtcacccaggctggagtgcagtggcgcaatctcagctcactgcaaccttcgcctccctggttcaagcaattctcctgccttagcctsccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttc

SEQ ID NO: 81798 - DNA, 601 bp, Human
atggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataattgctttttgttgttgttgttttgaaacagaatctcactgtcacccaggctggagtgcagtggcgcaatctcagctcactgcaaccttcgcctccctggttcaagcaattctcctgccttagcctcccgagtagccggkattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttccta

SEQ ID NO: 81799 - DNA, 601 bp, Human
aagtcctctaaactttcaagaaatcagtagtcgaacttttgggaaacacataattgctttttgttgttgttgttttgaaacagaatctcactgtcacccaggctggagtgcagtggcgcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgccygcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttcctagtagctgggactacgggtgtgtgccaccatgcctggctaaatttttaaaattttttgtagagattgggttttgctgtgtttcccaggctggtcttgaactcctggggac

SEQ ID NO: 81800 - DNA, 601 bp, Human
ctacgggtgtgtgccaccatgcctggctaaatttttaaaattttttgtagagattgggttttgctgtgtttcccaggctggtcttgaactcctggggaccctcagtctcccaaagcgctgggaatacaggcataagccaccatgcctgcctggtgtgtgtttaaactctttttttttttttttttttttttttttaccttccttcaacagctcagccaaacagcttcagcctccttggttagtcactagtgaactcttttgactgcagttggtctttctgtgtaactaaacagaaaggttkgcaccaagctcaggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagt

SEQ ID NO: 81801 - DNA, 601 bp, Human
caggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagttcatgtagcakagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactacc

SEQ ID NO: 81802 - DNA, 601 bp, Human
aataataaaaatatttatcctggagatatgcccagtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagasgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaaca

SEQ ID NO: 81803 - DNA, 601 bp, Human
gtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacrtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcag

SEQ ID NO: 81804 - DNA, 601 bp, Human
ccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgyagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaat

SEQ ID NO: 81805 - DNA, 601 bp, Human
tatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacakgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaattcactttatatttcgtgtaaaaaatgggagtcactaatttgactaactttcccac

SEQ ID NO: 81806 - DNA, 601 bp, Human
ggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctrctttatggggctactgtattttaattatttagactgtagtcatgaccccagatcaaccagatagaaatgaaagtattagtcaattcactttatatttcgtgtaaaaaatgggagtcactaatttgactaactttcccaccaaactgatttttaagctgcattgcataactgtgttacgtcatgtgggtgtgtctatgagctaacttttcacattgcattgtggtgatatttgaattgaggctggtctttaatgattctgtgtccctgtatcagtgccttcacagaattcttattctctac

SEQ ID NO: 81807 - DNA, 601 bp, Human
ttcaagaccagcctggccaagatggtgaaaccccgtctctactaaaactacaaaaattaaccaggcacagtggcaggcacctgtaatcccagctactcgggaggctgaggcaggagaaacgcttgaacccgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagttyaccacttgggatctcccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttg

SEQ ID NO: 81808 - DNA, 601 bp, Human
cgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagtttaccacttgggatctcccaggaagccgaggactccccgtctccagagttgaatagctgagccatgccgaagtaacctgaatctttctattttactgacctctacattgctctaaaaaatacagtgatttrtatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactacaaaggactaaatttttatttaaaattgtttgaaagtgttgtatatattatataatcacgtgtgaaaaactatgactaatgaacttcatcaagctctaaacattaatcctctga

SEQ ID NO: 81809 - DNA, 601 bp, Human
ccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactayaaaggactaaatttttatttaaaattgtttgaaagtgttgtatatattatataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttctgcttc

SEQ ID NO: 81810 - DNA, 601 bp, Human
aactacaaaggactaaatttttatttaaaattgtttgaaagtgttgtatatattatataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttcwgcttcctgtgtcctgccccaggtgagcccagcctcatacccatccctgcttggaagcatagccctttcattgatttcaggctcattgattgctcatgaccttagctttttgatgggttcaataaatgttacaatcttctatttatccagctttttctcatcattagaacagaaacaaaactcttcccagccttgtacatcgtaagtggaaacctgaagtccctgttgtgattattttgtaaggctgtctacagagacacatagtatcagaacaatttatcaaatcatttttaagcaaata

SEQ ID NO: 81811 - DNA, 601 bp, Human
catagtatcagaacaatttatcaaatcatttttaagcaaatatgcattttgtaaaatcatcataaaacactacccattaggaaatcccttctttctgagaattttatgttagtttttctctctttttttaatctttaggcctcagaggagctccaggatactccttggatcaagcccaccatcttcccattgaaatggatccattaataggtatgttaataaaaaagaataaattttcatggatactatccatatattcatatatagttatttttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctgatgtaaatgacaagttgatgggtgcagc

SEQ ID NO: 81812 - DNA, 601 bp, Human
tttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctratgtaaatgacaagttgatgggtgcagcaaaccaacatggcacatgtatacctatgtaacaaacctgcacattgtgcacatgtaccccagaacttaaatttaaaaaaaaaaaaaaaagggccgggcatggtggctcacgcctgtaatcccagtactttgggagtccaagacgggcggatcacgaggtcaggagatcgagaccatcctggctaacacggtgaaaccccgtctctactaaaaatataaaaaaattagccaggcgcggtggcgggcacctgtagtcccagctactcgggaggc

SEQ ID NO: 81813 - DNA, 601 bp, Human
tttaaactgacatgttgtaaagcaaatgtttcatatgaattgcaaactgatgagctataactctttgcagcagacattcaaaatatttttaaataatcgtgtacatatttattagccattggatccagagctagcatcttagtctttcgaggcccttccggtttcatatatgtaagacagtttttaataatgtttgttctatctgtatcactggatgattagtaagataaattagaaaaaaattgaaaatgctacgaaaaattattaagctacatattaaagtcaaggtgttttattcttrggttcttttttttttttttttttgagatggagtctcattatgtcacccaggctggagtgcagtgatgcaatctcagaccactgcaacctccgcctcccaggttaaaccaattcccccacctcagcctcctgagtagctgggattacaggcgtgcaccaccacgcctgtctaatttttgtatttttagtagagacagggtttcaccgtgttggccaggctggtctcgaactcctgaccttaagtgatctgcctgcctggccctcccagagtcctgggattacagacgtgagccaccacgcg

SEQ ID NO: 81814 - DNA, 601 bp, Human
catgtattccgaacgttagcatgatcccagaattcataggacaaatggggctattgttcctttcccacaaattcatatgcagtaaaagatcctaaaactccccttggtctggcccaaaccctgaagagaaaaatcgtgattgtgttattttataaagtcttttctttaaaaatctcaagtgacattcttgtatcagtttccaaaagcaatgcaagaaagcaacctgtagccagatttgaataacattgtaactttgtcagcccatagatgaacttttcacaaaactggtaaaataaaattwaaaatatggtaaaattttttaaaaaatctgataaagttacacttattaccatttgaagaaaaagactaaatgaagcaaacctgtcatttctgtgttgcagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtttgtatcaaatttgtcctatc

SEQ ID NO: 81815 - DNA, 601 bp, Human
caggattattcaaattgtcacagcttacacagcactccaaaataaactgaaacatgaatttggggaatacttataacccaacagagataaaaatttttcaggaaacctgtgcatctacaactaaaatactataagagtagataagaaatctacaagatgccatgttacattgcgtggctggctgctgcctctctggttagttccaacctgtgagacagctaggggtggaaactgaattgcacatccacccttcatgtcccactccatccccccaacccttatgcattttgacaggaatacygcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatcttgatttgagggaaaagat

SEQ ID NO: 81816 - DNA, 601 bp, Human
attttgacaggaatactgcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatcttkatttgagggaaaagatattcaatgttgcttgatttccaaccagttcaaataattagttaccaattctgttattaacaaacattatgctctaaataccagtaagataatctccctatttactcttttgtaaagccatgtccgtaaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaatt

SEQ ID NO: 81817 - DNA, 601 bp, Human
aaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaattgtctttatttccataatagtgtagcatttctttaaaaagtttaattaagcagcaggtctgtgtagtatctttcatatacattgataaaaattagaacttgttagaaaaaatttaaaagaaacagaatagagctttaaatctaattaattaccgtcttcaaaatgaagcccagaaatgatgcaagtgttatttccaaaaaggggatttatttcttaaaagctgccatctggtagctgagataagatgttttatataatatactgctaggaggtaaagaatattaaagaaaaatattaaattatagtaattatctatgttcactactgtgttttctaatgatctcttaaaccaaaagatggctaactatcaattgtagctttggtacatcagttagcaagaaaagttaaatacaataatatttaaattatttaaagctccttaca

SEQ ID NO: 81818 - DNA, 601 bp, Human
gctgcaaagtcacaacctctgactttctagagtttacaagaatctacttttatactgatcacaaactgtttctcctgcttggatatactgaggatgtcaagtatttgttaaatgaatcatgaattgttatccgataatattttgtaccatactttaaggattcgtaaaatgcttaactttacatcaaattgatgattatgaaaaaaactggttttagcttttttccataaggatgatcacagtagtaaaaaagtgatctcaggtttagtattgattgactgactgatttgtgacccacttwtctatttaaaaagctaacctagtagcatatatatgcctgactagggcaaccatctgtgtcggtctcttcactcttttttcaggcagtcacagcacacactgaattgactgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttat

SEQ ID NO: 81819 - DNA, 601 bp, Human
actgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttatgtctaaatttgtattaaagtgtgtgacacaatgcccttaggttttggaggttgtatgtattaacctatccttgacgtgggaagtcctggcatgtaacataatatccyagtagctgttataatgaagggattggccttggtgtggacatggaactgctttgtgtgtcaccgaggccaaatcacacctgttcatcacaacatcatgaaatgataggatttatcatttaacctttacatgcatatcactaaaatcttctcaagataaaattcaactgactttaacatatttgtttctcttgcattgtcattattatattgtaatagatagctctattaattccacgaagaaaaaatgtcatgtttgtgaaatctttttggcaggtatagaaagtatgtatggttttattg

SEQ ID NO: 81820 - DNA, 601 bp, Human
cagtgtcccacaaatgaggtttaaaataagaaccatgagttctttactttggccatttctctaaaagccagagaccatctcactaaaaaacctctcctgtctatgtgaataagcagcatctaatactagtatatttttttatcatccattttgagaatattgaaatgacctttgataaaaggaggatggaatttgtttattttaagccttttaatattcggagtttccaaatgcatgtctataaggaatctaaaaattggacgtgtttgttcttcatcagttctagtcattccagcacacrgtgagtgcttctgtggaggcagtggtgggcctgagggcaacggcggtggccctcagaggggcggtccacctgcacctccctctgcactgggccctttaaccctgggctacatccatcaactgtgatgtgacagtgacagaatattcctaggattttgaatgattgttggggtgtgtgacatctgtccctagcaacgaaatgaaatataggaaacaagctttcccgccgctgcaggtttcccaactcagaaagcctggaatggcattttatttgcctttcacttaaagaaggaaacagtgc

SEQ ID NO: 81821 - DNA, 601 bp, Human
attgttggggtgtgtgacatctgtccctagcaacgaaatgaaatataggaaacaagctttcccgccgctgcaggtttcccaactcagaaagcctggaatggcattttatttgcctttcacttaaagaaggaaacagtgctttcaggggccctaaaaaataccccctaatagttaagttccacagtttattcagatgatctggggaaatcgtaatgaaaaaaataaaatattttaaactctctaaatcagacatgagcctttgaaaaactcatttcctagcagaaaatgtataacatgcatwaggaatatttttatacattttttttctcaattccctgcaataggatcagattgctttttattttttctatagcatattagggaaaggtcccaaaactattcattttatataaatgaattaagtgtataatttcagggttttccagtgtgctagtctctccaagataaaattatcatttagaaaaattaaacctgatattacacataaaatcttacaaatacttttttagagatttaatttttatggatacataatagttgtacatattgatgggatatgttatacaaggatacaatgtgt

SEQ ID NO: 81822 - DNA, 601 bp, Human
tccacccacctcagcctcccaaattgctgggattacaggcgtgagccaccacacccagcctctttggagtttttgtagaagatctttcatttcaggaagtcaggaaacttaggtcctagttctggctcaaatagcagttctctgtgggaagactcccaggcagaaaggagcctgatgcttggagaaactgaaaggagccctgggtgctgctggagtatcaccgtggtgccacaacctggaggaatgagaaggctgaagggatgggaggggcctggggcacaagcatttgcaatttttttttaaatgagtatagtaggaaactattgaagttttttaatcgaggtgatgagatagataggtttggttgttagagctcatttcagcctttctacggagaatggatagagtctgaaggctggcaccatgtttttaaaattttggtatctaagaataaataacccagaaatggacacataggatattttcagtcttttaattttaaaaagtaataatatgtgtaatatcattttaccctgtgaagttaaaaaaaaaaaaaaaaaggaaaataagtgacacatagtaggcgccaagaaagagacat

SEQ ID NO: 81823 - DNA, 601 bp, Human
ctggcttatatgatgtgagggaaacacgtatttttcagcagaggtgggattcagtgtgagacctacttcttgctaaccagtttccagcaaagtgcatagtgtgggccgtagctggcccccctttcaacagcatgcggcactcacgcattacccagaacaatttttttacccccatgttcttatttacctgtttctcatttatgttattttgttttattgtatgtatttccttaaaacacgttaatcctttaatccagctctttcttggaaagagttgatatggatgttaatcaattaatartgattttccattgttcctcaatttgcaataggattttattatttcctgaaatttacctttgggtttcttacaaagtgaaaataatattagaaatataaagtctaaagttcctaagcctttaaaataaactacaaccctgtaatctgaatatggcatgtgatttctaatttttgctatttaacagaaataagaaaagcttgttaatcaacgtttttcccaactacatgtaatattcctcataacagtattggttttaaaatattttaaatattaagacataataaagttaacaaagcatct

SEQ ID NO: 81824 - DNA, 601 bp, Human
cttcttgagggctgggaagggcaggaaagaccttagaagaggctcatccattcaccaggcatgaacagacagggtggatggaagagcatattcaaagttgcagtagtattagggggtctcaatggaggggggaaagatactaagtttctatttctattttaacctcatccttggttttgattattttgttgttttataatgaatagtgcatgcatatcaattataaactgataaacatatattggggatattactcaaaaggtatttattggatgaggtgtctaatcaaaagtgaagcaayactttatgtagacagaaatcctgaaacctgagttcagtcagtggcagtgggactggggaggaatatccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccaggga

SEQ ID NO: 81825 - DNA, 601 bp, Human
tccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccagggagactgtggaccgagaggacaagaggtggagtgattcaagggggcaaagaaaagaaaggtcacagasataggaagagatgccagatatcctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatac

SEQ ID NO: 81826 - DNA, 601 bp, Human
ctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatactgtctagtgtaaaatagcaaccrcagaaatgattttatatcactcttaactgctgtttctgcttttccaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttacttt

SEQ ID NO: 81827 - DNA, 601 bp, Human
cctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtrgtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatgttctcccaattctgggtagagca

SEQ ID NO: 81828 - DNA, 601 bp, Human
gagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctgrtcacgtctgtgtcctcagcagtagtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatg

SEQ ID NO: 81829 - DNA, 601 bp, Human
tctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcgcttttaactcatattgacactttcctcctgttattcwtaaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctgggaaatatttgttaaatcaattctgtcttttgggtttaac

SEQ ID NO: 81830 - DNA, 601 bp, Human
cccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcrcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctggga

SEQ ID NO: 81831 - DNA, 601 bp, Human
aacacagtctgatagggattagagaagtcctggcccaagtgtgaataagtatccagttgcaaggagcattgaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctyttcaaggcagttgtccatgactttgctcaaagtagagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatga

SEQ ID NO: 81832 - DNA, 601 bp, Human
agcaaatactacctattaagtattatgtgctaagggtttttaaagactatcttatttaatctttataaagtaaaaagttgacaccattattctccccattttatagataaggaaactgaggcacagacagattaagtgatttgcccaaagtctcaccatagttaagtactagagccaggattcaaacccaaggactctggttccacctaaagcactgagctacatggtccaacacagtctgatagggattagagaagtcctggcccaagtgtgaataagtatccagttgcaaggagcattsaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcat

SEQ ID NO: 81833 - DNA, 601 bp, Human
atctacagtgcacaggacagcccccacaacaaagaatcatcccaccccaaatgtcaatagtgccatgtttgagaacccctgggttacagtgacaatagtttccatcacattcttggagtccgaactgggttaaccatctagaattggggatgctcatctggccttgtccaagggagccttgctgatgggaggccaagcagagcggaagtgagaagaccaaggtccgtgttttcagctggacacacagggctctctaagtttgctgagagactgtagcttacccactcaggcctggggtacyttcccccatggagcaccaaataacaggctagacagtgctgctgggtctactgtgtgggtcacggtaacactagtactgctgttattaataccacacacttaggtccttgcaggcctggtgaaaaatgacaagtgcttaccctttcatggagccccctggcatgcccaccccaggataggccaacagatctgcctgaccttaggaagactcaactcagggactcacaaggagtttaaaggtgaaatcagtcttgaaagccagttcttctgggagcagactccagtttctagggaaacctcg

SEQ ID NO: 81834 - DNA, 601 bp, Human
cccatctcggggccaggcacagtggctcacgcatgtaatcccacactttgggaggatgaggaggtcagatcacctgaggtcgggagttcgagaccagcctggccaacatggtgaaaccttgcctctactaaaaatacaaaaaaattagccaggcatggtggtgcacacctgtagtcccagatacatgggaggctgaggtgggagaatcacttgaacccgggaggtggaggttacagtgagccaagatcacaacactgcactccagcctgggccacagggcaagactctgttaaaaaaaaacacacacacacacacacacacatacacaaagtaccccatctccctgccaggctgattggtttaggaaggagcacatggctgagctggaccaatcagagtcctccctgagactgctgtagccattaatggaaatgcttcttgctgggattcacaggtcaatgagatgtgaaactttattatgtgaaactttctaccacgtaggaataggctgcccgagaatggctaaacaggcagaaagtgagtgggaggaaggaagagggggatagtggaggggagagaaagaaagagagaaaaaaaccca

SEQ ID NO: 81835 - DNA, 601 bp, Human
gcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaaggacascttgaggaacttcatctaagtcagggcaaggagatcagctcaaaagacctttggacaaacagtgaggaagccgtctggagggcatgatgggcatggatatctgactgcctggcactcctttttcccttccttgggtagcagagcacccctttccaagggaacgatcctgtgtggctctactgttggggcagcccacattctcaaggatgggcacaggacacaggatttgccaatccaagtaccccatctcggggccaggcacagtggctcacgcatgtaatcccacactttgggaggatg

SEQ ID NO: 81836 - DNA, 601 bp, Human
gaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatatttcagatgaggttcytgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaag

SEQ ID NO: 81837 - DNA, 601 bp, Human
acttggactggatgggaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatayttcagatgaggttcttgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagca

SEQ ID NO: 81838 - DNA, 601 bp, Human
taaaagactaaatccgtgtctgtaagcctgccatgacactgctttatttatgcttaatggatcacactgcaaattgtttccaatcttttggaagaccattggtagatgctatttgtatacaaaatgatatcagtgtttaaattatctcatggaaatttcgagttaattatttaaaagaagaaaaatatatctgcaagaatatgtttatctcagagttatcaacactatatcaatgtctaagaacaggccaatggttatgtaagttatggctttcccaattgatagaaaaatatgcactcaytgaaattatatttatgaaatttaggtagcagcatcaaagaataatttcagcaaggaaaagaataaaaacatgtataattagacttactgccatattaaaatatgtataaacatgaataaagactagaagagaatatgagaaaaaagacatgttagactagtggtgatgtggaaaagtatttccatcctgataattcagtatttaatgataaacacattctaatataaatcaacatttaataactgtaaagaggtgtgaaattgctaagttagtggttcttaagtttgcctacacattaga

SEQ ID NO: 81839 - DNA, 601 bp, Human
tacagtgagccatgatcgtgccactccactccagcctgattgacagagtgagaccgtgtctcaaaaaaaaaaagaaaagaaaaagaaaaaaagcttcttcttttcaaacagctagtgtggattccactttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagraatctaggatggattcgtgctgacttcccatagctggatcaaaaggaaaactcctggggctggggtcagggaacctaaggccaattaacataaactttctaaagctaaaacaaaaggaaaaaccccatctccccatgccccagcagcaaagaatcaaaggctactctccctacagccctcccccttccaccacgtctcagctggaaagggagagtgtcttagattggccctgagccaagcagagacgaccatccctttacccacagagggcgccaattcaccttagcctttagttagcca

SEQ ID NO: 81840 - DNA, 601 bp, Human
agcactttgggaggccgaggtgggaggatcacttgatcccaagaattcgagatcagcctgggcaacacagggagacccccatctctacaaaaataataaaaagtattagctgtcctggtggtatgcacctgtggtcccagctacttgggaggcaaaggtgggaggaggttgaggctacagtgagccatgatcgtgccactccactccagcctgattgacagagtgagaccgtgtctcaaaaaaaaaaagaaaagaaaaagaaaaaaagcttcttcttttcaaacagctagtgtggattccmctttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagaaatctaggatggattcgtgctgacttcccatagctggatcaaaaggaaaactcctggggctggggtcagggaacctaaggccaattaacataaactttctaaagctaaaacaaaaggaaaaaccc

SEQ ID NO: 81841 - DNA, 601 bp, Human
actagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggtgcactcagcatcctcagcatctgccccgattccagtgctgcaacctgaatgtcctggcttcygggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttatagggacaactccaaatgtgacccaggagtccccagagctccttaacaagactgagccagagttatcc

SEQ ID NO: 81842 - DNA, 601 bp, Human
gcaaagcaattgatttaaaatcaacacacccacctatacaaaacttaaaaccacatgcacaaactagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggygcactcagcatcctcagcatctgccccgattccagtgctgcaacctgaatgtcctggcttccgggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttataggga

SEQ ID NO: 81843 - DNA, 601 bp, Human
acccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacasaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacatttaaataaaataaaaaaaaaacaatccaagaaaagtcaccaggaaatagaatcaaacacattaaggaa

SEQ ID NO: 81844 - DNA, 601 bp, Human
gacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacawgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacat

SEQ ID NO: 81845 - DNA, 601 bp, Human
ctgtgcttttcagtctgtctcattgccaaaaactactgattagaaacaattcagtggagagtataggtccctgtccaggagaggcactggagggagacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcraaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaat

SEQ ID NO: 81846 - DNA, 601 bp, Human
agcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagcyggtgattacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgcgggagacaagaggctgaacgctactgctggcaaagtctctcccacacgcacatgttccctctagaaaa

SEQ ID NO: 81847 - DNA, 601 bp, Human
ctcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgarctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccagatggatgtggctggaagtcagaggacattctcgtgggttcgtgggcctagggtacaaatgacctc

SEQ ID NO: 81848 - DNA, 601 bp, Human
gttgctctcctatggatcccatctcggcctgccagtatttccccagaagaagatactcagtttaactcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggaraagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccag

SEQ ID NO: 81849 - DNA, 601 bp, Human
ctggaaggacccaccatcctttccccacccatgaggcccatttccctttaaagctcaaagtaggaaataacaaaatcctgattgaaatctgtgggagattgcaagacaatctcccacagagattgtctctgtggtggcctgaacacctacctgcttcaccggggagggcactggagagagcatggaaactgaggcaggtgttccaggagcagactgagagaagaggaggagggcagagtggggaactaggcaagcacatggggacagcctccagaagcctcccagggggagagcttttacyccaccatccctgacccttgtgtgatacaggaaaagaggcatttagacacaggcggaactcctggttattctattctatatggttttggggtccttcaggtaaggagcgcttcagttttcactcctgccagtgggcagtggcttattcatgtggcctcgttctagtcacatacatttctgccttcacggggctattttcaggatccagcgataaatgcacacaggatgtctgacatggtctgttgttgctctcctatggatcccatctcggcctgccagtatttccccagaagaagatact

SEQ ID NO: 81850 - DNA, 601 bp, Human
cattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacamaacactattgtatcagtcaagataacagcaagacaccgctggctcattgaaactgggtaattgaggagcatttaataaacatgtgcatagaatttagggaatccagtaaggggtgcttcagtatgctgaggctggcaatagtggtgggtcattcccactgctgggcctacagaggagaggatggaacaggtggctggacttggagatgggagctgtttgctgagaggcttgaaggagccttcagaggggaatgcagccactcctgccaccacctgccagggagggagccctgaggacaga

SEQ ID NO: 81851 - DNA, 601 bp, Human
tgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcagtggcattgatggcaacatgtccagactgtctcatgtggcctctgctgtccattctctcttggcttctgcccattttctaaacccratcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacacaacactattgtatcagtcaagataacagcaagaca

SEQ ID NO: 81852 - DNA, 601 bp, Human
tccagtaccaaacacctttttcttttggggggacaggccccaatgtgtgagtttcaccagatgcagagttctgcttccccttctattgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcrgtggcattgatggcaacatgtccagactgtctcatgtggcctctgctgtccattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagcta

SEQ ID NO: 81853 - DNA, 601 bp, Human
cttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcaccccgcaccatggttcccaaggacaggcacrtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttccctgagctaacctgtccaggcacaggcatggagaccccagttataacagtaatagcagtaaccacc

SEQ ID NO: 81854 - DNA, 601 bp, Human
ctcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcmagcctttctgctacatcctccctctttaatatcaccccgcaccatggttcccaaggacaggcacgtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttcc

SEQ ID NO: 81855 - DNA, 601 bp, Human
tctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagagrggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcac

SEQ ID NO: 81856 - DNA, 601 bp, Human
ttgtaccacattacctgatcccattccagtccatcccaaagatataagaggaaactcccattagtgggcacttctgctgggctgtctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccaygaggctgggtggctactttacaattgacaaaccttgggggaagtgtgactcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtg

SEQ ID NO: 81857 - DNA, 601 bp, Human
ctttacatctcccaggatatcagcacagtgctgggggattgctctgctgaatccacctaattctctcaacttcaagatgcagtagagggacctccagcttctgtttcatcgcccagtccctcctgggtcaggctggacaagcaccgtctgcatgcattgcctcctttccctttcccatttgtaccacattacctgatcccattccagtccatcccaaagatataagaggaaactcccattagtgggcacttctgctgggctgtctacatccctctccctggtcccctcttccccagcctgyttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagaggggcaggctggccacccttgtgacagcttccttcctgcc

SEQ ID NO: 81858 - DNA, 601 bp, Human
ccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattcccatttggtcccagagggcagtcaacctraacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggctgagacaggatttgccccagccctgtctg

SEQ ID NO: 81859 - DNA, 601 bp, Human
ctgggttcaagtgatcctcccatctcagcccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattmccatttggtcccagagggcagtcaacctgaacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggc

SEQ ID NO: 81860 - DNA, 601 bp, Human
ccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccakcctgtcctgatattcacatattcagattagcatatattcaaatagcagaagagcaatgtcctctgctaattaatggaggcctctcaaattcactagcttgaaaagagttttatagaaaaacttgaggcaaaagcactgagctccaccatcccagttccacctccccatgtaggcaggaaggcttgctaacaaaggaggagggggaattggcagtgtttccaccaatgagaagcaaccgaaggtcaccaaaatgtccttcattttcctccctaataactgtgcctcatctactgctattga

SEQ ID NO: 81861 - DNA, 601 bp, Human
cagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcagagagggaccaagaatccacaatcttctattgccctgtgatggctgcccttacctttgcaaaggactgaagttttagtatttatgtmacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccagcctgtcctgatattcacatattcagattagcatatattc

SEQ ID NO: 81862 - DNA, 601 bp, Human
tgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcwgagagggaccaagaatccacaatcttctattgccctgtgatggctgcccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgctt

SEQ ID NO: 81863 - DNA, 601 bp, Human
gtcatgctcttttccctgcaaattcaagcgggggaaatgattgggtcagggagcccatacaggagataggcaaggacgtttcacttggcatcctttatggtccctctgcaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttstcatttaacagtatgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaa

SEQ ID NO: 81864 - DNA, 601 bp, Human
caaaaacacagcatgtttgcatttttgtttgcttacagttgaccttgccatctttcagggcgtaggttttcctttataacatgaatgcaaggattgagttccagcctgggagaagaactgacttatccgaaagtgcccagtgtgcagtggtgggagaggatgggattccacatccagccttctgatgccaaatgtcatgctcttttccctgcaaattcaagcgggggaaatgattgggtcagggagcccatacaggagataggcaaggacgtttcacttggcatcctttatggtccctctscaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttctcatttaacagtatgcgctcagtctttctcaaccatttctcttgtcttttttaagacttaaattaaagaactgggcagaactccaatgatggattcataccagaagg

SEQ ID NO: 81865 - DNA, 601 bp, Human
tgcactgctgttgtgctccccagagcgtctgggcttaccaccagcaccccaaggagaaggagaagcgtggccatttccaggcaaacaggcaggagcaagagctgggacctgcaggtgggcagccggagaagcagaacacgcgggagttgccggaggacctggccgggcctcccctctgcccacttccctgccaacggccaggcccaacctgcggtttaacggttttttccatgctggcttttactgttatcagaaatgacagaggaacagatgctggcagctcccccatcagccccatccygaggctccctccagcctcagcagcttagattccagcagtgaccagcccctcctggccttccctgaccctgtgcagcccaatggctcccaatctcttcccatcataacctgtcagagtcttttcaagccacaggcacattcccaggcccactgaggcccctaccccaccaagtctcaccctcttaccggctcggctgataaggacgcagcactggggccaggtcactccaccacctcccgaggctggggcaagactgggaaggacagggccccaaggggaaaggaagtgggccctggctcc

SEQ ID NO: 81866 - DNA, 601 bp, Human
gttttcatcaatggcagtagttctcagcgtagggagattttgctctccatcccccaaggtcacttacagggatatatggcaatgtctgaagacattctgagttttgacaattagagtgggtgtggggattttaccagcatctagtgggcagaagccacggaggccactaaacatgctacgacgcacaagatagcctccatgacaaaacgtcaacagtgtcactgtggaaaaacccagatctgtggtgttatttgcgctcatcctaaaatgactatttaccagatcttcttttttcagaaayaactatcaagatatttctggcaaggatctgattacctgaatctaccacatcattcttatatttacctgaaaggaatataggatgtctctccaaagattaatattctatatgcttcttctggggttctccccaaatatataacctatgtttgaaaaaagaagaaaaaggcaatttatttctaagtgaagatacagtgctgtcactgcgaagtaaattttgtccaatttccaaccaactgagcagggttctccagccttccccaggagcctaggaatcacccagaatcctgtccatagattt

SEQ ID NO: 81867 - DNA, 601 bp, Human
atggggtctgtctttgttgccgaggctggtctggaactcctgggctcacgcaatcattccaccttggcattccaatatgctgggattacaggcatgagccactgtgcccagccaaagcttagttttcatcaatggcagtagttctcagcgtagggagattttgctctccatcccccaaggtcacttacagggatatatggcaatgtctgaagacattctgagttttgacaattagagtgggtgtggggattttaccagcatctagtgggcagaagccacggaggccactaaacatgctacracgcacaagatagcctccatgacaaaacgtcaacagtgtcactgtggaaaaacccagatctgtggtgttatttgcgctcatcctaaaatgactatttaccagatcttcttttttcagaaacaactatcaagatatttctggcaaggatctgattacctgaatctaccacatcattcttatatttacctgaaaggaatataggatgtctctccaaagattaatattctatatgcttcttctggggttctccccaaatatataacctatgtttgaaaaaagaagaaaaaggcaatttatttc

SEQ ID NO: 81868 - DNA, 601 bp, Human
ctaccacccctggctgaaaattcagaagtttaggattcaaatataatgcacaacccaatggtctctacatcgataagaaagaggagagaatccatgtgctagtttatcccaaacaaaaccctcatacttcatccatatcttcattttcaaattcttccgaacagtctttaatcaatgttccctaaagtaaacagctctgacatcaacactaaaatcaaaacttttgaggaaaaaaaagatattctttccataggaataaaacaaaaaaaatttctgtcctatcctatagccttactctgtrtgatagcaggcagagtatgataaccaaaataagcagagtgtctattttctgagacaaggacaaacagacctagcagcctctgagaaatatcctcctggctgctgatccctgagccaaacaggagggaagcaagaattgctgatccacaaggtattcttggttcaaagagggggcttttgtacacccagttttcaaaagtaaactactgaaatacaaatgtaaaataagaaggctagaatatcaactaaaaaggtcttcattttatatagttatttaaacactaatcccaagactaagtca

SEQ ID NO: 81869 - DNA, 601 bp, Human
tttttattttttttgtagagacagaatctcactatgttggccaggctggtctcgaactcctgggctcaagtgatcctgctgccttgaactcccaaagcactgggattacaggcatgagccactgtgtccagcctcagcttggtgtttcttaatccattggtctgggttctagcagtgaggaaggaaacctcctcccatttggaagggcagaagctctttccaatgactatacttccaaatggtcacctggatacatctgtgaccaaatattagagcctctactgagcatctgctgtgtgcrgagtactgctaatcaatttggaaatggctgatttggcttatcatgtcatttttattgttgacctcatcactgtcatcattaaaaattacatgtcaggccaggcgcagtggctcacgcctgtaatcccagcactttaggaggctgaggcgggcagatcacgaggtcaggagtttgagaccagcctggccaacacggtgaaaccccatctctactaaaaatacaaaaattagcgaggcgtggtggcgtgtgcctgtattcccagctactcaggaggctgaggcaggagaatcacttgaaccc

SEQ ID NO: 81870 - DNA, 601 bp, Human; identical to SEQ ID NO: 53204

SEQ ID NO: 81871 - DNA, 601 bp, Human; identical to SEQ ID NO: 53205

SEQ ID NO: 81872 - DNA, 601 bp, Human; identical to SEQ ID NO: 53206

SEQ ID NO: 81873 - DNA, 601 bp, Human; identical to SEQ ID NO: 53207

SEQ ID NO: 81874 - DNA, 601 bp, Human; identical to SEQ ID NO: 53208

SEQ ID NO: 81875 - DNA, 601 bp, Human; identical to SEQ ID NO: 53209

SEQ ID NO: 81876 - DNA, 601 bp, Human; identical to SEQ ID NO: 53210

SEQ ID NO: 81877 - DNA, 601 bp, Human; identical to SEQ ID NO: 53211

SEQ ID NO: 81878 - DNA, 601 bp, Human; identical to SEQ ID NO: 53212

SEQ ID NO: 81879 - DNA, 601 bp, Human; identical to SEQ ID NO: 53213

SEQ ID NO: 81880 - DNA, 601 bp, Human; identical to SEQ ID NO: 53214

SEQ ID NO: 81881 - DNA, 601 bp, Human; identical to SEQ ID NO: 53215

SEQ ID NO: 81882 - DNA, 601 bp, Human; identical to SEQ ID NO: 53216

SEQ ID NO: 81883 - DNA, 601 bp, Human; identical to SEQ ID NO: 53217

SEQ ID NO: 81884 - DNA, 601 bp, Human; identical to SEQ ID NO: 53218

SEQ ID NO: 81885 - DNA, 601 bp, Human; identical to SEQ ID NO: 53219

SEQ ID NO: 81886 - DNA, 601 bp, Human; identical to SEQ ID NO: 53220

SEQ ID NO: 81887 - DNA, 601 bp, Human; identical to SEQ ID NO: 53221

SEQ ID NO: 81888 - DNA, 601 bp, Human; identical to SEQ ID NO: 53222

SEQ ID NO: 81889 - DNA, 601 bp, Human; identical to SEQ ID NO: 53223

SEQ ID NO: 81890 - DNA, 601 bp, Human; identical to SEQ ID NO: 53224

SEQ ID NO: 81891 - DNA, 601 bp, Human; identical to SEQ ID NO: 53225

SEQ ID NO: 81892 - DNA, 601 bp, Human; identical to SEQ ID NO: 53226

SEQ ID NO: 81893 - DNA, 601 bp, Human; identical to SEQ ID NO: 53227

SEQ ID NO: 81894 - DNA, 601 bp, Human; identical to SEQ ID NO: 53228

SEQ ID NO: 81895 - DNA, 601 bp, Human; identical to SEQ ID NO: 53229

SEQ ID NO: 81896 - DNA, 601 bp, Human; identical to SEQ ID NO: 53230

SEQ ID NO: 81897 - DNA, 601 bp, Human; identical to SEQ ID NO: 53231

SEQ ID NO: 81898 - DNA, 601 bp, Human; identical to SEQ ID NO: 19722

SEQ ID NO: 81899 - DNA, 601 bp, Human; identical to SEQ ID NO: 19723

SEQ ID NO: 81900 - DNA, 601 bp, Human; identical to SEQ ID NO: 19724

SEQ ID NO: 81901 - DNA, 601 bp, Human
gcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggsacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctct

SEQ ID NO: 81902 - DNA, 601 bp, Human
agaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatktatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacat

SEQ ID NO: 81903 - DNA, 601 bp, Human
cctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggartcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagt

SEQ ID NO: 81904 - DNA, 601 bp, Human
ttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaackgttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttcttt

SEQ ID NO: 81905 - DNA, 601 bp, Human
catttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcmtttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaaga

SEQ ID NO: 81906 - DNA, 601 bp, Human
agcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttygcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtc

SEQ ID NO: 81907 - DNA, 601 bp, Human
cacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcaragacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagc

SEQ ID NO: 81908 - DNA, 601 bp, Human
tcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccrttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaact

SEQ ID NO: 81909 - DNA, 601 bp, Human
gcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcrttggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaa

SEQ ID NO: 81910 - DNA, 601 bp, Human
agctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctmgtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcc

SEQ ID NO: 81911 - DNA, 601 bp, Human
actgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttragcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaacta

SEQ ID NO: 81912 - DNA, 601 bp, Human
aatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctcc

SEQ ID NO: 81913 - DNA, 601 bp, Human
taaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttkttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggt

SEQ ID NO: 81914 - DNA, 601 bp, Human
ctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctyagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtg

SEQ ID NO: 81915 - DNA, 601 bp, Human
acaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgaggracagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtact

SEQ ID NO: 81916 - DNA, 601 bp, Human; identical to SEQ ID NO: 19725

SEQ ID NO: 81917 - DNA, 601 bp, Human; identical to SEQ ID NO: 19726

SEQ ID NO: 81918 - DNA, 601 bp, Human; identical to SEQ ID NO: 19727

SEQ ID NO: 81919 - DNA, 601 bp, Human; identical to SEQ ID NO: 19728

SEQ ID NO: 81920 - DNA, 601 bp, Human; identical to SEQ ID NO: 19729

SEQ ID NO: 81921 - DNA, 601 bp, Human; identical to SEQ ID NO: 19730

SEQ ID NO: 81922 - DNA, 601 bp, Human; identical to SEQ ID NO: 19731

SEQ ID NO: 81923 - DNA, 601 bp, Human; identical to SEQ ID NO: 19732

SEQ ID NO: 81924 - DNA, 601 bp, Human
agagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatrttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgt

SEQ ID NO: 81925 - DNA, 601 bp, Human
cttttcctgacaggctgatttctcagacatcaaggacccagtcttactcacttttgtgaacccagaggcccaatttttaaaaaatagatttgatgtggatgaagaaagggttcatttgttattgatgagataagaagctctttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccawgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgatttt

SEQ ID NO: 81926 - DNA, 601 bp, Human
ctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctrtgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagaca

SEQ ID NO: 81927 - DNA, 601 bp, Human
ccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattamttttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggca

SEQ ID NO: 81928 - DNA, 601 bp, Human
ccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtartggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaag

SEQ ID NO: 81929 - DNA, 601 bp, Human
agcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcrattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaagg

SEQ ID NO: 81930 - DNA, 601 bp, Human
tctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaatasgtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgt

SEQ ID NO: 81931 - DNA, 601 bp, Human
aaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaamagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactct

SEQ ID NO: 81932 - DNA, 601 bp, Human
agacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcartggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtg

SEQ ID NO: 81933 - DNA, 601 bp, Human
aatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggwttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtg

SEQ ID NO: 81934 - DNA, 601 bp, Human
ccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataraagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttc

SEQ ID NO: 81935 - DNA, 601 bp, Human
tagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtragcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtcc

SEQ ID NO: 81936 - DNA, 601 bp, Human
gattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatrgaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaa

SEQ ID NO: 81937 - DNA, 601 bp, Human
ggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtascagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaat

SEQ ID NO: 81938 - DNA, 601 bp, Human
gtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctaygtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgca

SEQ ID NO: 81939 - DNA, 601 bp, Human
ttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgstctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctattt

SEQ ID NO: 81940 - DNA, 601 bp, Human
ttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgsctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctga

SEQ ID NO: 81941 - DNA, 601 bp, Human; identical to SEQ ID NO: 19733

SEQ ID NO: 81942 - DNA, 601 bp, Human; identical to SEQ ID NO: 19734

SEQ ID NO: 81943 - DNA, 601 bp, Human; identical to SEQ ID NO: 19735

SEQ ID NO: 81944 - DNA, 601 bp, Human; identical to SEQ ID NO: 19736

SEQ ID NO: 81945 - DNA, 601 bp, Human; identical to SEQ ID NO: 19737

SEQ ID NO: 81946 - DNA, 601 bp, Human; identical to SEQ ID NO: 19738

SEQ ID NO: 81947 - DNA, 601 bp, Human; identical to SEQ ID NO: 19739

SEQ ID NO: 81948 - DNA, 601 bp, Human; identical to SEQ ID NO: 19740

SEQ ID NO: 81949 - DNA, 601 bp, Human; identical to SEQ ID NO: 19741

SEQ ID NO: 81950 - DNA, 601 bp, Human; identical to SEQ ID NO: 19742

SEQ ID NO: 81951 - DNA, 601 bp, Human; identical to SEQ ID NO: 19743

SEQ ID NO: 81952 - DNA, 601 bp, Human; identical to SEQ ID NO: 19744

SEQ ID NO: 81953 - DNA, 601 bp, Human
atagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggartcgcttgaacccaggaggcggagattgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcagga

SEQ ID NO: 81954 - DNA, 601 bp, Human
atagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagatygcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagag

SEQ ID NO: 81955 - DNA, 601 bp, Human
gtggtgcgcacctgtagtcccagctacttgggaggctgaggcaggggagtcgcttgaacccaggaggcggagattgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcstggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaagaatacgatgtaatgattaccattttacttttaaaatttctacaaacacggaaaaagaaagaaaatgcatcagtgttctgttctcaccagttaatactggatcatggataattatgttctttaatatatttttattttcaaagt

SEQ ID NO: 81956 - DNA, 601 bp, Human
aagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaagaatacgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaac

SEQ ID NO: 81957 - DNA, 601 bp, Human
agtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccartcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaa

SEQ ID NO: 81958 - DNA, 601 bp, Human
acagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaaggggagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcac

SEQ ID NO: 81959 - DNA, 601 bp, Human
ttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaamtcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataatt

SEQ ID NO: 81960 - DNA, 601 bp, Human
tgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatgggktgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctcta

SEQ ID NO: 81961 - DNA, 601 bp, Human
ttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagrcagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattg

SEQ ID NO: 81962 - DNA, 601 bp, Human
tagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagyatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaac

SEQ ID NO: 81963 - DNA, 601 bp, Human
cacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatakagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctatt

SEQ ID NO: 81964 - DNA, 601 bp, Human; identical to SEQ ID NO: 19745

SEQ ID NO: 81965 - DNA, 601 bp, Human; identical to SEQ ID NO: 19746

SEQ ID NO: 81966 - DNA, 601 bp, Human; identical to SEQ ID NO: 19747

SEQ ID NO: 81967 - DNA, 601 bp, Human; identical to SEQ ID NO: 19748

SEQ ID NO: 81968 - DNA, 601 bp, Human; identical to SEQ ID NO: 19749

SEQ ID NO: 81969 - DNA, 601 bp, Human; identical to SEQ ID NO: 19750

SEQ ID NO: 81970 - DNA, 601 bp, Human; identical to SEQ ID NO: 19751

SEQ ID NO: 81971 - DNA, 601 bp, Human; identical to SEQ ID NO: 19752

SEQ ID NO: 81972 - DNA, 601 bp, Human; identical to SEQ ID NO: 19753

SEQ ID NO: 81973 - DNA, 601 bp, Human; identical to SEQ ID NO: 19754

SEQ ID NO: 81974 - DNA, 601 bp, Human; identical to SEQ ID NO: 19755

SEQ ID NO: 81975 - DNA, 601 bp, Human; identical to SEQ ID NO: 19756

SEQ ID NO: 81976 - DNA, 601 bp, Human; identical to SEQ ID NO: 19757

SEQ ID NO: 81977 - DNA, 601 bp, Human; identical to SEQ ID NO: 19758

SEQ ID NO: 81978 - DNA, 601 bp, Human; identical to SEQ ID NO: 19759

SEQ ID NO: 81979 - DNA, 601 bp, Human
gagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatgrtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttt

SEQ ID NO: 81980 - DNA, 601 bp, Human
aggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaaygagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagc

SEQ ID NO: 81981 - DNA, 601 bp, Human
agcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcakactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaa

SEQ ID NO: 81982 - DNA, 601 bp, Human
catggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacataygtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtga

SEQ ID NO: 81983 - DNA, 601 bp, Human
catcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatgkcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagg

SEQ ID NO: 81984 - DNA, 601 bp, Human
atgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgyggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaag

SEQ ID NO: 81985 - DNA, 601 bp, Human
gtggagttctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgatargattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaa

SEQ ID NO: 81986 - DNA, 601 bp, Human
tgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcstgggctccagtgattctcctgcctcagcctcccaagtagctgggactacaggcacgcaccaccacactcagctaatttaaaaaaaaattttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatat

SEQ ID NO: 81987 - DNA, 601 bp, Human
aggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccmagtagctgggactacaggcacgcaccaccacactcagctaatttaaaaaaaaattttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctg

SEQ ID NO: 81988 - DNA, 601 bp, Human
aggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctayggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttc

SEQ ID NO: 81989 - DNA, 601 bp, Human
gatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcamatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttatt

SEQ ID NO: 81990 - DNA, 601 bp, Human; identical to SEQ ID NO: 19760

SEQ ID NO: 81991 - DNA, 601 bp, Human; identical to SEQ ID NO: 19761

SEQ ID NO: 81992 - DNA, 601 bp, Human; identical to SEQ ID NO: 19762

SEQ ID NO: 81993 - DNA, 601 bp, Human; identical to SEQ ID NO: 19763

SEQ ID NO: 81994 - DNA, 601 bp, Human; identical to SEQ ID NO: 19764

SEQ ID NO: 81995 - DNA, 601 bp, Human; identical to SEQ ID NO: 19765

SEQ ID NO: 81996 - DNA, 601 bp, Human; identical to SEQ ID NO: 19766

SEQ ID NO: 81997 - DNA, 601 bp, Human; identical to SEQ ID NO: 19767

SEQ ID NO: 81998 - DNA, 601 bp, Human; identical to SEQ ID NO: 19768

SEQ ID NO: 81999 - DNA, 601 bp, Human; identical to SEQ ID NO: 19769

SEQ ID NO: 82000 - DNA, 601 bp, Human; identical to SEQ ID NO: 19770

SEQ ID NO: 82001 - DNA, 601 bp, Human; identical to SEQ ID NO: 19771

SEQ ID NO: 82002 - DNA, 601 bp, Human
cagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcatartaatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggta

SEQ ID NO: 82003 - DNA, 601 bp, Human
gcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacagrtatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaa

SEQ ID NO: 82004 - DNA, 601 bp, Human
ttgacaggtatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacrcctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctga

SEQ ID NO: 82005 - DNA, 601 bp, Human
caagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctrtgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttcca

SEQ ID NO: 82006 - DNA, 601 bp, Human
ctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcat

SEQ ID NO: 82007 - DNA, 601 bp, Human
agatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttrtatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcac

SEQ ID NO: 82008 - DNA, 601 bp, Human
atgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacct

SEQ ID NO: 82009 - DNA, 601 bp, Human
tttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacraatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaat

SEQ ID NO: 82010 - DNA, 601 bp, Human
taaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcac

SEQ ID NO: 82011 - DNA, 601 bp, Human
tcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggrgaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcat

SEQ ID NO: 82012 - DNA, 601 bp, Human
acaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcrtgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgt

SEQ ID NO: 82013 - DNA, 601 bp, Human
ggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaaytttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttgggga

SEQ ID NO: 82014 - DNA, 601 bp, Human
gctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctmggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactaga

SEQ ID NO: 82015 - DNA, 601 bp, Human
gtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaayttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatctt

SEQ ID NO: 82016 - DNA, 601 bp, Human
gaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgacygaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaa

SEQ ID NO: 82017 - DNA, 601 bp, Human
acaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactayttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctt

SEQ ID NO: 82018 - DNA, 601 bp, Human
actaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattwaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttctt

SEQ ID NO: 82019 - DNA, 601 bp, Human
caaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgrtgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttc

SEQ ID NO: 82020 - DNA, 601 bp, Human
ggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctaccwttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcct

SEQ ID NO: 82021 - DNA, 601 bp, Human
actgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcrgcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttg

SEQ ID NO: 82022 - DNA, 601 bp, Human
ttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgttt

SEQ ID NO: 82023 - DNA, 601 bp, Human
tttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaawcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtt

SEQ ID NO: 82024 - DNA, 601 bp, Human
acttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaaktccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagttt

SEQ ID NO: 82025 - DNA, 601 bp, Human
acatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaargagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtgga

SEQ ID NO: 82026 - DNA, 601 bp, Human; identical to SEQ ID NO: 19772

SEQ ID NO: 82027 - DNA, 601 bp, Human; identical to SEQ ID NO: 19773

SEQ ID NO: 82028 - DNA, 601 bp, Human; identical to SEQ ID NO: 19774

SEQ ID NO: 82029 - DNA, 601 bp, Human
gttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatytgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatga

SEQ ID NO: 82030 - DNA, 601 bp, Human
aaaaaatatctagtcaagtttcttcccacatccagcgatgcctcatgagaaggtatcatctttttggtatacaagacctactgcttttttaacattatctgcttgctatagatagtacctaaagtcatatctgagtttctgaaaagagatgtcagtgttttaatgaactgacatatcaatcaaagtgacaaactaaaactatacacacacacacacacacacacacacacacacacacacacacaccattgtatcttcatttatttttatttttttgagacaggatctcgctctgttgccyaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgt

SEQ ID NO: 82031 - DNA, 601 bp, Human
tgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttcyccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcac

SEQ ID NO: 82032 - DNA, 601 bp, Human
actttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggycagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctg

SEQ ID NO: 82033 - DNA, 601 bp, Human; identical to SEQ ID NO: 53527

SEQ ID NO: 82034 - DNA, 601 bp, Human; identical to SEQ ID NO: 53528

SEQ ID NO: 82035 - DNA, 601 bp, Human; identical to SEQ ID NO: 53529

SEQ ID NO: 82036 - DNA, 601 bp, Human; identical to SEQ ID NO: 53530

SEQ ID NO: 82037 - DNA, 601 bp, Human; identical to SEQ ID NO: 53531

SEQ ID NO: 82038 - DNA, 601 bp, Human; identical to SEQ ID NO: 53527

SEQ ID NO: 82039 - DNA, 601 bp, Human; identical to SEQ ID NO: 53528

SEQ ID NO: 82040 - DNA, 601 bp, Human; identical to SEQ ID NO: 53529

SEQ ID NO: 82041 - DNA, 601 bp, Human; identical to SEQ ID NO: 53530

SEQ ID NO: 82042 - DNA, 601 bp, Human; identical to SEQ ID NO: 53531

SEQ ID NO: 82043 - DNA, 601 bp, Human; identical to SEQ ID NO: 30207

SEQ ID NO: 82044 - DNA, 601 bp, Human; identical to SEQ ID NO: 30208

SEQ ID NO: 82045 - DNA, 601 bp, Human; identical to SEQ ID NO: 30209

SEQ ID NO: 82046 - DNA, 601 bp, Human; identical to SEQ ID NO: 30210

SEQ ID NO: 82047 - DNA, 601 bp, Human; identical to SEQ ID NO: 30211

SEQ ID NO: 82048 - DNA, 601 bp, Human; identical to SEQ ID NO: 30212

SEQ ID NO: 82049 - DNA, 601 bp, Human; identical to SEQ ID NO: 30213

SEQ ID NO: 82050 - DNA, 601 bp, Human; identical to SEQ ID NO: 30214

SEQ ID NO: 82051 - DNA, 601 bp, Human; identical to SEQ ID NO: 30215

SEQ ID NO: 82052 - DNA, 601 bp, Human; identical to SEQ ID NO: 30216

SEQ ID NO: 82053 - DNA, 601 bp, Human; identical to SEQ ID NO: 30217

SEQ ID NO: 82054 - DNA, 601 bp, Human; identical to SEQ ID NO: 30218

SEQ ID NO: 82055 - DNA, 601 bp, Human; identical to SEQ ID NO: 30219

SEQ ID NO: 82056 - DNA, 601 bp, Human; identical to SEQ ID NO: 30220

SEQ ID NO: 82057 - DNA, 601 bp, Human; identical to SEQ ID NO: 30221

SEQ ID NO: 82058 - DNA, 601 bp, Human; identical to SEQ ID NO: 30222

SEQ ID NO: 82059 - DNA, 601 bp, Human; identical to SEQ ID NO: 30223

SEQ ID NO: 82060 - DNA, 601 bp, Human; identical to SEQ ID NO: 30224

SEQ ID NO: 82061 - DNA, 601 bp, Human; identical to SEQ ID NO: 30225

SEQ ID NO: 82062 - DNA, 601 bp, Human; identical to SEQ ID NO: 30226

SEQ ID NO: 82063 - DNA, 601 bp, Human; identical to SEQ ID NO: 30227

SEQ ID NO: 82064 - DNA, 601 bp, Human; identical to SEQ ID NO: 30228

SEQ ID NO: 82065 - DNA, 601 bp, Human; identical to SEQ ID NO: 30229

SEQ ID NO: 82066 - DNA, 601 bp, Human; identical to SEQ ID NO: 30230

SEQ ID NO: 82067 - DNA, 601 bp, Human
atctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgagggttaaaaactcyggtagccaagactctgaagccaggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctg

SEQ ID NO: 82068 - DNA, 601 bp, Human
ctggtagcatgggactgctgctcacgatgggcagcagcctggcatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcaygtggacatctgcctaggtcctactatcctagaattcgcatgtcttatcacacaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattcttgggcataatgggagcaatatttaaaaaaaaaaa

SEQ ID NO: 82069 - DNA, 601 bp, Human
aggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattcaagagaagaaagaaaatttatgacgactagctgggtgagaattagaactgtaaccctgggaaggtcctggtgatttgactctcacaggacacctgatgaccagaggatgggtttcctttgatgggaaatctgtggcgattcattgatgggcytctgaattctgctgaagcagaggaagtagtaataccccatttataatggaagtgcattctcacttaaaaacaactaatattattctagctggacctagcctctagaaacagccaaattacatttgacttgagtggattcataataattaaaaaatttctggggcatgggataaatgtgttaggtattgctaagtcaaggcagccctatcccctcagcagaagtgagggaatatgaaagtgtgtgaatgctaacataattttggggaatatcgccgtcagatttccagatgatattccaac

SEQ ID NO: 82070 - DNA, 601 bp, Human
aggtttcagatgtgaacactgaactcatcgttttcttttttgggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaagsagtgatttgtgtatgtgctgatatagctcagtatgtctttgaaaccagttgtctggggctaggcctgcaatcagcttttggctaagaggtcccaggatggaacaagtagtgtgaaagaggactgataccttggcctcacacacagtactgctcttagactggggcaagtgaaactcctcacttcagagtgccccattctaggccccctcactcccaaaggggtgagggatcactggggccatgggaatgtgcttgttcagctctcgtgggctctccttctgtaccacgttctggacatct

SEQ ID NO: 82071 - DNA, 601 bp, Human
aatgaatctggaaggtctggcttcagatctcttgtgctgagtcactcgcatactttactacctctaaggtttctaatcagaggaatttgtatctgtattccctgctactcttaccctctatgtgggatttggcctttctccattatccctgtgaactcgctctgggaccttccttcttgtacttggaaccatcagaaagtgatctgagaacatagaaatctactgtgttgtgaaacagaattacctggaagcggaaaaagccctcctggctcaattcacatgtcacggcttatggtcgtayccggggaacatatgaaactgggcactgagtgcggagtcaggaaagccctgtccatcctctgggtttctggggaaaacgtggaccccttcattgtcactttctcctgtatatttttgtttttacttttagaactgtacaattacgtaataaataataaaaagtcgttggaaggataggtgaagttcagaagtgaaagtgttttggaggagtctaagctccttcccaccctcattgacctttcctctctaataaatagaactggtctaaccaaggatctgtggaatgagcagagtccaacgg

SEQ ID NO: 82072 - DNA, 601 bp, Human
acattagggcttggactatggaaaaagtattgggcagcatgcctcatactgagttgtttaatgaatttaaaagtatagccttaatagtgagagaaactctatagcttcataatataaattgggtaactaatgagataaaatggttggcagatctgctcactagaatctaagctcttcaagggtctgagtttttttttttctttttcttttattatactttaagttctagggtacatgtgcacaacgtgcaggtttgttacataggtatacatgtgccatgttggtttgctacacccatcarctcgtcatttacattaggtatttctcgtaatgctatccctcccttggccccccaccccacaacaggccccggtatgtgatgttcccctccttgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattga

SEQ ID NO: 82073 - DNA, 601 bp, Human
agaaactctatagcttcataatataaattgggtaactaatgagataaaatggttggcagatctgctcactagaatctaagctcttcaagggtctgagtttttttttttctttttcttttattatactttaagttctagggtacatgtgcacaacgtgcaggtttgttacataggtatacatgtgccatgttggtttgctacacccatcaactcgtcatttacattaggtatttctcgtaatgctatccctcccttggccccccaccccacaacaggccccggtatgtgatgttcccctccytgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattgatggacatttgggttggttccaggtctttgctattgtgaatagtgccacagtaaacatacatgtgcttgtgtcttcatagttggacgagtta

SEQ ID NO: 82074 - DNA, 601 bp, Human
gtgacgggccttgactgtttatccaatttgccagtctgcgtcttttaactggggcatttagcccacttatatttaaggttaatattgttatgtttgaatttgatctgtcattatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtraaggattttatttctccttcacttgtgaaacttagtttggctggttatgagattctgggttgaaaattctttaagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttg

SEQ ID NO: 82075 - DNA, 601 bp, Human
tgtttgaatttgatctgtcattatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtaaaggattttatttctccttcacttgtgaaacttagtttggctggttatgagattctgggttgaaaattctttaagaatgctgaatattgrcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcact

SEQ ID NO: 82076 - DNA, 601 bp, Human
ttatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtaaaggattttatttctccttcacttgtgaaacttagtttggctggttatgagattctgggttgaaaattctttaagaatgctgaatattggcccccactctcttctggctwgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaacaatcatag

SEQ ID NO: 82077 - DNA, 601 bp, Human
ggtgacaaaatctctgagcatttgcttgtctgtaaaggattttatttctccttcacttgtgaaacttagtttggctggttatgagattctgggttgaaaattctttaagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatrtctttgtggtgttctctgtatttcctgaatttgaatgttgacctgccttgctaggttggggaagttctcctggataatatactgaagagtgttttgtaacttggttccattctgtctatcactttcaggtacaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagctt

SEQ ID NO: 82078 - DNA, 601 bp, Human
taagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggktccattctgtctatcactttcaggtacaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttc

SEQ ID NO: 82079 - DNA, 601 bp, Human
ttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaamaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtc

SEQ ID NO: 82080 - DNA, 601 bp, Human
ctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaacartcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtcag

SEQ ID NO: 82081 - DNA, 601 bp, Human
acaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatsggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatctttgtggttttatctacctttggtctttgattttggtgacgtacagatgggttttggtgtgggtgtcctttttgttgatattgatcctattcctttgtttgttagttt

SEQ ID NO: 82082 - DNA, 601 bp, Human
ttggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtcagaacgtgctsctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatctttgtggttttatctacctttggtctttgattttggtgacgtacagatgggttttggtgtgggtgtcctttttgttgatattgatcctattcctttgtttgttagttttccttctaacagagg

SEQ ID NO: 82083 - DNA, 601 bp, Human
ttgtttatgctttgtgaaattcttgtactttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcytttctgctgtggtttctccccatctttgtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggt

SEQ ID NO: 82084 - DNA, 601 bp, Human
tgaaattcttgtactttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtktctccccatctttgtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggtgtctgtcggcccct

SEQ ID NO: 82085 - DNA, 601 bp, Human
ctttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatcttygtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggtgtctgtcggcccctactgggaggtgtc

SEQ ID NO: 82086 - DNA, 601 bp, Human
accaagctccagcatcccagcttgatctcagactgcttggctagcagcaagcaaggttccatgggcatgggaccccccgagccaggcactggaggcaatcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccartgagatgaaccaggtacctcagttggaaatgcagaaatcacccatcttctgcatcgatcttgctgggagctgtagaccagagctgttcctactgggacatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttaaacccagctttatgttgaagcatctcattatacattg

SEQ ID NO: 82087 - DNA, 601 bp, Human
atcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccagtgagatgaaccaggtacctcagttggaaatgcagaaatcacccatcttctgcatcgatcttgctgggagctgtagaccagagctgttcctactgggrcatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttaaacccagctttatgttgaagcatctcattatacattggaaagatgaaatgtgtagtgagactttgaatcttcttttgaatctagaaacattagcatttttagaccattctattttaatatttatgaaatttatg

SEQ ID NO: 82088 - DNA, 601 bp, Human
cctccatgggctgcacccactgtccaaccagtgccagtgagatgaaccaggtacctcagttggaaatgcagaaatcacccatcttctgcatcgatcttgctgggagctgtagaccagagctgttcctactgggacatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttamacccagctttatgttgaagcatctcattatacattggaaagatgaaatgtgtagtgagactttgaatcttcttttgaatctagaaacattagcatttttagaccattctattttaatatttatgaaatttatgaaataataagaaacatgaggccgggctcagtggcttatgcctgtaatcccagcagtttgggaggccagggctagtggatcatgaggtcaggaatttgagaccagcttggccaacatggtgaaaccccacttctactaaaaatataaaaattagctgggcgtggtggt

SEQ ID NO: 82089 - DNA, 601 bp, Human; identical to SEQ ID NO: 30231

SEQ ID NO: 82090 - DNA, 601 bp, Human; identical to SEQ ID NO: 30232

SEQ ID NO: 82091 - DNA, 601 bp, Human; identical to SEQ ID NO: 30233

SEQ ID NO: 82092 - DNA, 601 bp, Human; identical to SEQ ID NO: 30234

SEQ ID NO: 82093 - DNA, 601 bp, Human; identical to SEQ ID NO: 30235

SEQ ID NO: 82094 - DNA, 601 bp, Human; identical to SEQ ID NO: 30236

SEQ ID NO: 82095 - DNA, 601 bp, Human; identical to SEQ ID NO: 30237

SEQ ID NO: 82096 - DNA, 601 bp, Human; identical to SEQ ID NO: 30238

SEQ ID NO: 82097 - DNA, 601 bp, Human; identical to SEQ ID NO: 30239

SEQ ID NO: 82098 - DNA, 601 bp, Human; identical to SEQ ID NO: 30240

SEQ ID NO: 82099 - DNA, 601 bp, Human; identical to SEQ ID NO: 30241

SEQ ID NO: 82100 - DNA, 601 bp, Human; identical to SEQ ID NO: 30242

SEQ ID NO: 82101 - DNA, 601 bp, Human; identical to SEQ ID NO: 30243

SEQ ID NO: 82102 - DNA, 601 bp, Human; identical to SEQ ID NO: 30244

SEQ ID NO: 82103 - DNA, 601 bp, Human; identical to SEQ ID NO: 30245

SEQ ID NO: 82104 - DNA, 601 bp, Human; identical to SEQ ID NO: 30246

SEQ ID NO: 82105 - DNA, 601 bp, Human; identical to SEQ ID NO: 30247

SEQ ID NO: 82106 - DNA, 601 bp, Human; identical to SEQ ID NO: 30248

SEQ ID NO: 82107 - DNA, 601 bp, Human; identical to SEQ ID NO: 30249

SEQ ID NO: 82108 - DNA, 601 bp, Human; identical to SEQ ID NO: 30250

SEQ ID NO: 82109 - DNA, 601 bp, Human; identical to SEQ ID NO: 30251

SEQ ID NO: 82110 - DNA, 601 bp, Human; identical to SEQ ID NO: 30252

SEQ ID NO: 82111 - DNA, 601 bp, Human; identical to SEQ ID NO: 30253

SEQ ID NO: 82112 - DNA, 601 bp, Human; identical to SEQ ID NO: 30254

SEQ ID NO: 82113 - DNA, 601 bp, Human; identical to SEQ ID NO: 30255

SEQ ID NO: 82114 - DNA, 601 bp, Human; identical to SEQ ID NO: 30256

SEQ ID NO: 82115 - DNA, 601 bp, Human; identical to SEQ ID NO: 30257

SEQ ID NO: 82116 - DNA, 601 bp, Human; identical to SEQ ID NO: 30258

SEQ ID NO: 82117 - DNA, 601 bp, Human; identical to SEQ ID NO: 30259

SEQ ID NO: 82118 - DNA, 601 bp, Human; identical to SEQ ID NO: 30260

SEQ ID NO: 82119 - DNA, 601 bp, Human; identical to SEQ ID NO: 30261

SEQ ID NO: 82120 - DNA, 601 bp, Human; identical to SEQ ID NO: 30262

SEQ ID NO: 82121 - DNA, 601 bp, Human; identical to SEQ ID NO: 30263

SEQ ID NO: 82122 - DNA, 601 bp, Human; identical to SEQ ID NO: 30264

SEQ ID NO: 82123 - DNA, 601 bp, Human; identical to SEQ ID NO: 30265

SEQ ID NO: 82124 - DNA, 601 bp, Human; identical to SEQ ID NO: 30266

SEQ ID NO: 82125 - DNA, 601 bp, Human; identical to SEQ ID NO: 30267

SEQ ID NO: 82126 - DNA, 601 bp, Human; identical to SEQ ID NO: 30268

SEQ ID NO: 82127 - DNA, 601 bp, Human; identical to SEQ ID NO: 30269

SEQ ID NO: 82128 - DNA, 601 bp, Human; identical to SEQ ID NO: 30270

SEQ ID NO: 82129 - DNA, 601 bp, Human
tcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggasggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacac

SEQ ID NO: 82130 - DNA, 601 bp, Human
cccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaayaccctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattcca

SEQ ID NO: 82131 - DNA, 601 bp, Human
cagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgagrctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatat

SEQ ID NO: 82132 - DNA, 601 bp, Human
cactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagayagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattct

SEQ ID NO: 82133 - DNA, 601 bp, Human
agactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcayagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaa

SEQ ID NO: 82134 - DNA, 601 bp, Human
acagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaartgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaaca

SEQ ID NO: 82135 - DNA, 601 bp, Human
tacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaawaaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcac

SEQ ID NO: 82136 - DNA, 601 bp, Human
ttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaawaaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtggg

SEQ ID NO: 82137 - DNA, 601 bp, Human
acttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcargagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcaga

SEQ ID NO: 82138 - DNA, 601 bp, Human
cagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaacccygtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaa

SEQ ID NO: 82139 - DNA, 601 bp, Human
tttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaacyataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttag

SEQ ID NO: 82140 - DNA, 601 bp, Human
tgccaaaaaatgtccgaatctgaactttaaatctccccatatatccctcgccctattaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggatyactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttctta

SEQ ID NO: 82141 - DNA, 601 bp, Human
gtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttca

SEQ ID NO: 82142 - DNA, 601 bp, Human
ttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggayaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaa

SEQ ID NO: 82143 - DNA, 601 bp, Human
ctacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagrgcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaat

SEQ ID NO: 82144 - DNA, 601 bp, Human
gaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcstgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaa

SEQ ID NO: 82145 - DNA, 601 bp, Human
agttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatayatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcata

SEQ ID NO: 82146 - DNA, 601 bp, Human
tagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacstagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatt

SEQ ID NO: 82147 - DNA, 601 bp, Human
tctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaamgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatag

SEQ ID NO: 82148 - DNA, 601 bp, Human
agcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttrtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataa

SEQ ID NO: 82149 - DNA, 601 bp, Human
aaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttrtgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctg

SEQ ID NO: 82150 - DNA, 601 bp, Human
gttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcytaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataat

SEQ ID NO: 82151 - DNA, 601 bp, Human
gtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccrccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatg

SEQ ID NO: 82152 - DNA, 601 bp, Human
tacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttayatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggac

SEQ ID NO: 82153 - DNA, 601 bp, Human
ccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataayaactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggtta

SEQ ID NO: 82154 - DNA, 601 bp, Human
taaatatccttctcatcatttccttttaaatttctaaaagtcaaaatctagttgctttttctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctayaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaataca

SEQ ID NO: 82155 - DNA, 601 bp, Human
cactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttktctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaa

SEQ ID NO: 82156 - DNA, 601 bp, Human
ggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagmttcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatg

SEQ ID NO: 82157 - DNA, 601 bp, Human
aatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcrtaagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagagg

SEQ ID NO: 82158 - DNA, 601 bp, Human
ttcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattccyctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgaga

SEQ ID NO: 82159 - DNA, 601 bp, Human
cgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcraaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtct

SEQ ID NO: 82160 - DNA, 601 bp, Human
atgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcarcagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggccc

SEQ ID NO: 82161 - DNA, 601 bp, Human
aatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaayagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaac

SEQ ID NO: 82162 - DNA, 601 bp, Human
tataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaaytactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgta

SEQ ID NO: 82163 - DNA, 601 bp, Human; identical to SEQ ID NO: 18618

SEQ ID NO: 82164 - DNA, 601 bp, Human; identical to SEQ ID NO: 18619

SEQ ID NO: 82165 - DNA, 601 bp, Human; identical to SEQ ID NO: 18620

SEQ ID NO: 82166 - DNA, 601 bp, Human; identical to SEQ ID NO: 18621

SEQ ID NO: 82167 - DNA, 601 bp, Human; identical to SEQ ID NO: 18622

SEQ ID NO: 82168 - DNA, 601 bp, Human
taccatttagttttgtgtaagtatgctctatgatgttcatctgtgataaaatcacttagggatgcttttctcagaacacatccccataacatatgactatattttccaagactaaatttaactccgaagataaggcaacacacacattcctttttttcccccataattttgtgactggatgactgaaaaaaaatgcttttaaacattaatccatccatccatgcatctatgcatccatgcatgcatccatccatccatccaacactcactgctgctactgcatggggattctcaaccttawaaaaaaaaagcaactctccctttccctaactacacctttcagttgattgagtccctgatgtcttccaggatctatgcctgaccctgggataggataataaagatggtctctaccctgaagagatgagaaagaagtaggtaagtaatggtgtaagttaaggctgctctgatagcagtgtctgttttcttcccattcttcccaacttcaaataggatccagcctgataaactggccttgagtagccaatacaaaagtaaaatttacaagttttttttgttttttgttttttgtttttttgag

SEQ ID NO: 82169 - DNA, 601 bp, Human
tattgactgggcgcaggggctcacacctgtaatcccagcactttgggaggctgaggtgggcggatcatgaggtcaggagtttgagaccagcctgagcaacaagctgaaaccccatctctattaaaaatacaaaatttagctgggcgtggtggcaggcacctgtaatcccagctactcaggaggctgaggcaggagaatccattgaaccagggaggcggaggttgcagtgagccaagacagcgccactacactccagcctggacaacagagcgagactttgtctcaaaaaaaaaaaaaaaaattattgactatagtccctctgttgtgctatcaaatactaggtctaattcattcatcctatttttttgtacccattataacctatttcttaatgactaaaaagtttattttccaaacaaacaaaaatgtagtgcagagagtggctttgttttacatttctacaaattgctttaatatctagtttaacagaagttggaatctcatatctgtttctttatttaatctgttagactatgttgttttggttataacaaggctgggcacagcacctcacgcctgtaatcccagcgctttggaaggc

SEQ ID NO: 82170 - DNA, 601 bp, Human
taagacagaagggaagacagggattacagtagaatatgggatctgagtgacagctgggactcagagggctttgtaggccaaacaaaagtctagatttcctaatgtgtgaaatggagagccaccaaagggtttggagcagaggagtgacaggattttattttttaaaaaggaatcagacaggcacagtgacattatctataatcccagctacttgggaggctgaggcaggagaatcacttgaggccaggagttcgagaccagactgggcaacacagtgagaccctgtctcaaaaaaaaaaaagaagtataaaaaaagcattctaaatttagtgtgaagaacagactgcaaatgttcaagagtaggccgggtgcagtggctcacgcccataatcccagcactttgggaggctgaggcaggtggatcccttgaggtcaggagttcaagcccagcctggccaaaatgacgaaaccctgtctctactaaaatataaaaattagctgggcatggtggcgggtgcctgtaatcccagcaactggggaggctgagacaggagaatcgcttgaaccctggaggcggaggttgcagtgagctgggattaca

SEQ ID NO: 82171 - DNA, 601 bp, Human
ggtgtcatttttgcaaaggcctgagtgaagaaacagaccaaggcttaggactacctaggggaagaacattccaggtagaggaaacagagcatataagtaggtcccagggcaggagggaggtgtttgacacatgtgaggcacaaggcacagcaatagagatatatgatgagtaagacagaagggaagacagggattacagtagaatatgggatctgagtgacagctgggactcagagggctttgtaggccaaacaaaagtctagatttcctaatgtgtgaaatggagagccaccaaagggtytggagcagaggagtgacaggattttattttttaaaaaggaatcagacaggcacagtgacattatctataatcccagctacttgggaggctgaggcaggagaatcacttgaggccaggagttcgagaccagactgggcaacacagtgagaccctgtctcaaaaaaaaaaaagaagtataaaaaaagcattctaaatttagtgtgaagaacagactgcaaatgttcaagagtaggccgggtgcagtggctcacgcccataatcccagcactttgggaggctgaggcaggtggatcccttgag

SEQ ID NO: 82172 - DNA, 601 bp, Human
aggagcccatgactgcactgcttgctatttcatgaagatgtgcatgacaacaaaggaggcacaatgttgaagccagcagctatagtccaaacttcttgatttggcagcttcctgtttgtagcacaggcagcttggttctggaaaatacagctacaaaagctgctcctgatttgacaatttcctaattatgaagtaggaggtctcttagaagccagttttgcagcatgctccaatagtcgatcttgaaaacctggcctagaactgtttcttcaaccttcctaacaattctgcaagctctctrtatcctttattaaaggctgttgtcctggctacaatagccagagtggatcttactgtatgcaacaaagaatccccaaaatatatgagtgtgaggaaagtacagtggcccataggagagggctgtcactgtagatactgtgttacacataattttatgcatttttttcctactgaatatacatagatctaaagtcttcatggcagggcttatgattaaaattttttttttatatatgtaagaggaaaagacacttctatagttatttacctgcaggtgttgtgcagacagatcaggagtggt

SEQ ID NO: 82173 - DNA, 601 bp, Human
ctcagtttttctgcaaatctaaaactattctaaaatatcaagtctactacttaaagaaaaattaaggtacatataatgttatacatttttttgtgacttttgtcttgttgataaaacaacttcttataaatctgtgactgtatccactttctacctttatttccaaaactaatacaaatatcattggatgaatagatgatatcaggatatacagacaaaatttcgtgttttatgaattcagagtttttcaatccaaagaggaattttctttcgtgagtttttcatcataaaagatagaacycaattttaagtagacccccttcaaaaagtttctgaaggcaaacttcagagtacattatatttgtattcaatcatagcaaccagcagtgaaaacatcgacataaccacaggcatgtggtgtataaaagtttttgagtctttgaagaataatgtgtaattttctattctagcgaaaactaaaatgatgtaatgttaacatatactacttcattccagagtaaagcaggagcccatgactgcactgcttgctatttcatgaagatgtgcatgacaacaaaggaggcacaatgttgaagccagc

SEQ ID NO: 82174 - DNA, 601 bp, Human
gaggcaggagaattgcttgaacccaggaggcagaggttgcagtgagccgagattgcaccactgcactacagtcagggtgacagcgcaagactccatctcaaaaaaaaaaaaaattttttttttacatgttcactttcaaaagtgaaatatgcattttatttcattacaaatcatattaaattgcactgaagttaaaaaatataagtgaataaagaactttgggaccgggcatgggggcttacacctgtaatcccagcactttgggaggccaaggaggggagggtggatcacctgaggtcasgagtttgagaccagcctggccaacatggtgaaactccatttccaataaaaatacaaaaattagccatgcgtgctggcatgcaccttagccccagctccttgggaggccgaggcaggagaatttcttgaatccaggaggtagaggctgcagtgagctgagatcacgccactgcattccagccggagcaacagtgagactctatatcacaaacaaagaactctgggaaaaaattagttaaatgttataggctacaaatatgaaccataaaaacgacatactcctttatttctcttcttactt

SEQ ID NO: 82175 - DNA, 601 bp, Human
tcttatatttgaataaaaagtacattagttacaattttaaatgctttaatattcacctaaaacttagaagcttatatagtctcttctacctagcaacatatctaactagattcttttttattttattttatttttttattgatcattcttaggtgtttctcgcagagggggatttggcagggtcataggacaatagtggagggacggtcagcagataaacaagtgaacaaaggtctctagttttcctaggcagaggaccctgcagcgttccacagtgtttgtgtccctgggtacttgagaytagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttctttctaactagattcttaagtttttgcccctaaaggctcttagccaacatagaaaactttcatcttgtgacttcagagttttggggcaatttatcagagaagcttaccatacggttgtcataa

SEQ ID NO: 82176 - DNA, 601 bp, Human
aattctgatactactttcttcaactgtaacttaaaactgtagttgattaaactaaaccttttacattaattttcatcactagaaattgaggagcaggatcaatatgattgcctagaaagacaagtgtttcgctctccatacacatcttcatctttagaagaaaaaattcctaggttttaagaccacatttctaatcttctaatattcacttactgattttgtcatttagaatataacctttcataatgaatgcaggttttcagtgaaaacttactatgccttaaattttctaagtgaaaayagaaatgtaggttaagcattcctaatactaaaatccaaaatgctctaaaatcagaaactttttgagcaccaacatgatgccacaagtggaaatttcacacctgacctctcatgatgggttgcagtcaaaaagcaggtgtattacagtttattcagtgtttattccctgtccccaagggaaaaaagatcctcccagctgagataaatcttttctgtatacgcccagactcccccaagtaagcacgcccactaaggatgataaaatggcacatgtacaggccagacatgccaatggcaagtt

SEQ ID NO: 82177 - DNA, 601 bp, Human
tatgatatatatatatatgatactacaagactatcagcctatttattttgtatacaaaagttacttagaacaagggtaagaacttatgtcaactttattatacacagtacaataggtcttaaattttatttaaaaattcagaaaacattttactcatgtttatttttgaaacacattctccctgtgtcagcaaggctggagtgcagtggcatgatcatggctcactgtaatcctgaactcctgggttcaagcaagcgatcctcccacctcaacctcccgagcagctgggactacatgtgcrcaccaccatgctcagctaatttttaaattatctgtagaaactgggcctcactatgttgctaaggctggtctcccaactcctggactcaagcaatcctgccaccttggcctcccaaagtgctgagattacaggcatgagctactgcacccgggcagagagtattttaaaatgtgtggtcacatagctaaatctaaactgtaacaatttgatattagaataataacaaactaatgttagcaaataattactcaaaatagttccccatatttttcaataagcctcctagagtttcttaaaatc

SEQ ID NO: 82178 - DNA, 601 bp, Human
agaagcatcttcatattttcatataataatatgtttttaaaagttatatattttatcgcttgagtccaggagggcagggctgcagtgagctatgatcacaccactgtactccagcctgggtgacacagcaagaccctgtctcaattaaacgaaattcttttcaattaattattttttaagaacattatatgtatgatatatatatatatgatactacaagactatcagcctatttattttgtatacaaaagttacttagaacaagggtaagaacttatgtcaactttattatacacagtamaataggtcttaaattttatttaaaaattcagaaaacattttactcatgtttatttttgaaacacattctccctgtgtcagcaaggctggagtgcagtggcatgatcatggctcactgtaatcctgaactcctgggttcaagcaagcgatcctcccacctcaacctcccgagcagctgggactacatgtgcgcaccaccatgctcagctaatttttaaattatctgtagaaactgggcctcactatgttgctaaggctggtctcccaactcctggactcaagcaatcctgccaccttggcc

SEQ ID NO: 82179 - DNA, 601 bp, Human
atcagggatatttctgactttaaaagcacaacaaacatactttgatttttgaaaggtagatcaaaatcaagcaacacaacatacaagttaaaaaaaacatatagaaataccctgaaagctacatgtgaatcgctgagaagtggcccctctttttcggtgtaatttatgcttgaatctccagtgattaggtgtacacttccttccatgcccgctactgagctctggcaggctgtgctctctccaggattcaatgcttttgcaagagtgtcaaatgccctgtatgaagacatcagaagctatsagcttgaccaaacaccgcaataaaataacaattctacataggattctggaattaagatttaagcctaaaaaactggccaggctggtctagaactcaagtgatatgcccgcctcagccttccaaagtgctgggattacaggtataagccacatgcctggcctaaagtctctttttaaaatcttgcataattaagggggagaagcatcttcatattttcatataataatatgtttttaaaagttatatattttatcgcttgagtccaggagggcagggctgcagtgagctatgatcacacca

SEQ ID NO: 82180 - DNA, 601 bp, Human
gacttaacaggatgctttattacgccattatcttatctacataaggctttagcctcctgcatagatgcacactaacatgcccagcttattcagtatcttgataaacagaagagaaaagcctaaagacattttgtttctatatgcagatgagtttttttttttttttttttgagacagagttttgctcttgttgcccaggctggagtgcaatggcgtgatctcggttcaccataacctccgcctcccgagttcaatcgattgtcctgcctcagcctcccgagtagctgggattacaggcatrcaccatcacacctggctgattttgtatttttagtagagacagggtttctccatgttggtcaggctggtctcgaactcctgacctcaggtgatctgcccaccttggcctcccaaaatgccaggattacaggcataagccactgtgcctggcccagatgagtgttttagctgctgttttgaaattctatcagggatatttctgactttaaaagcacaacaaacatactttgatttttgaaaggtagatcaaaatcaagcaacacaacatacaagttaaaaaaaacatatagaaataccctga

SEQ ID NO: 82181 - DNA, 601 bp, Human
cagtccattcaacacatcatgaatgccaatacttaaagtttaacaaaatgtgctgaaaagttataaaagctaacttttaaacgcaataactgctattataactgacttaacaggatgctttattacgccattatcttatctacataaggctttagcctcctgcatagatgcacactaacatgcccagcttattcagtatcttgataaacagaagagaaaagcctaaagacattttgtttctatatgcagatgagtttttttttttttttttttgagacagagttttgctcttgttgcccargctggagtgcaatggcgtgatctcggttcaccataacctccgcctcccgagttcaatcgattgtcctgcctcagcctcccgagtagctgggattacaggcatgcaccatcacacctggctgattttgtatttttagtagagacagggtttctccatgttggtcaggctggtctcgaactcctgacctcaggtgatctgcccaccttggcctcccaaaatgccaggattacaggcataagccactgtgcctggcccagatgagtgttttagctgctgttttgaaattctatcagggatatt

SEQ ID NO: 82182 - DNA, 601 bp, Human
taaaagttaaaatatattaaataatttgtatctttttaaattttattatgtaattttaatttataatagagatgaggtctcggcatgttgcccaggctggtctccaactcctggactcatgcaatcctctggcctcagcctcccaaagtactgcgatgacaggtgggagcagctgcacctggccaatttgtatcttataataatgctggaagccagctaattaagatgatacataacaaatggagctctttgtagttactatggtaagagcaaactatctgggtcttattgattacgatayagtagtagctaggcattgaacaaaagcagtccattcaacacatcatgaatgccaatacttaaagtttaacaaaatgtgctgaaaagttataaaagctaacttttaaacgcaataactgctattataactgacttaacaggatgctttattacgccattatcttatctacataaggctttagcctcctgcatagatgcacactaacatgcccagcttattcagtatcttgataaacagaagagaaaagcctaaagacattttgtttctatatgcagatgagtttttttttttttttttttg

SEQ ID NO: 82183 - DNA, 601 bp, Human
aaaacaattatctctacttttaacataaccactgtaggcaaaattcagctctttagtaacatgcctgggatgaacactgaaacagtagtgatgagagagaaacaagaacctagggcagtcttacagtctctctatctttgagccaatgaaagatgaggcctgttacaaatgctagccatagtcttatcaattctactgatcatattccatccaaattcttaacttagtcaaactacaaaatatggatactcttccacataaatacagagaaaatactagttagctgccatgatttgtcatwtgaatgacacaacttaaagctataatgttatactgttttttcctttaatgcaaatcttcccaaaataaaaagttttgtttaatgtacatttgcactacaaaatcacatttatattcaagatttcaaaacactcaccctagagcctggaaagaaggaatcgaaagtgcccagtgcattgataagaacagcagtctggaggcagactccccaatgtagtgcacattcaggtactcaggcataggagaaggcatggtgagctagtatgaacagggatttaggtaaattatcttatgactgaaa

SEQ ID NO: 82184 - DNA, 601 bp, Human
tatgcttcagtggtaatttaaaagattcagctgtctggcttggcatttaatggaaggctattgattacattattcaataaataaagtctcctgtggtaaacggtggtggcttggagcttttggttatattttaagaatctaggtagagatgactgctgccatacttactccaggcaaatcatgacaagtattctccactaccccgcaatggaatctaccactattcatatagtcacttaacctaaattttgcagggagaacttaaaaccaacaactgaattactctaagtactgaaactayaaatcttaaaacagaaaatcaatacctttgtaaaatacagaagccttgtaaaatattagtagtattaactgtatactgacaatcaacacctttgtaaaatatagaagccttgtaaaatacaaaggtactaaccatgcactgtttagtaaaattatttaagttactgttcccttcaattaaagtgatcaaaacaatcttgatttcagaaaatgattaatgttgcttatctgtttctctctgtaaaattaggactttgtcaccaacttttatatttttagataaaaatgcaatcttggccgg

SEQ ID NO: 82185 - DNA, 601 bp, Human
gtataaaaacagaatttgaacctttatgctcctttaaacctcattacacaatttagcaagtgaaatgctaaagtcagtaaatttctcagtagagactcctccatttaaggttaatattttgggatggtaagggcatgtttgctaccagtttttcctgttaggaaaataaatgactattgtagtttatgttcaaaacatctttaagaagcaaaaagagctgagtagagactgtagttaaggttatcactaaggcatctaaaaagcaacacgaatgttgagattaaaaaaaaaaaaaaaaaaaggccggatatgatggctcatgcctgtaatcccagtactttgggaggctcggctgggagaattgcttgaggcaaggagttcaagatcagcctggacaacagtgagacctccatctctagtttttaaaaaagcattaacttgtaaaattagtaaatatgttaatttcttttacaaataggtacaggtatttttctctaactactacactatattgtgggtttacttttttttttttttttgaaggagagtctcactctgtcacccaggctggagtacagtggcatgatctcagctcactaca

SEQ ID NO: 82186 - DNA, 601 bp, Human
gaagttagagtaaactcagtttcacttttaacctctgattctgaagttttaaggaggaaacagctaaccaaagtagtttgctagtaaacacaggaaaggaaaaataaatggaaaaaaatcagagctggcttgtgctatgcatcttgtagtaagaaagtaccttggcattgctggagaagctcagaaaaaaaggagtataagtgcaaaggataagaataccaaaattattactaaggaaaaaagacacaagtggcagatgagaaataacctaccagattattgtgtttccaaaagaaaaggraaaaggactgtagaaaccaactacagaaaggtatctatttacatttatctaaaccccaaaccaaaaaccctgatggtatagctagctatgtttttaaaagttcaattatgttaggaaagaaaaacagcaaggctactctaaaaagatggtctttaagagaatgacgaagaatgaccttttattatctactttgcagcaggcaatggcttagatgcatttacattcattatctcacctatgtgatgtagttcataatgaagtgtttctgctcccaatttacagacactgggcctcatttaa

SEQ ID NO: 82187 - DNA, 601 bp, Human
ctatacttcaatattactttaaacattaaaaaaaattaaaagctaacatgaaggaagttagagtaaactcagtttcacttttaacctctgattctgaagttttaaggaggaaacagctaaccaaagtagtttgctagtaaacacaggaaaggaaaaataaatggaaaaaaatcagagctggcttgtgctatgcatcttgtagtaagaaagtaccttggcattgctggagaagctcagaaaaaaaggagtataagtgcaaaggataagaataccaaaattattactaaggaaaaaagacacmagtggcagatgagaaataacctaccagattattgtgtttccaaaagaaaagggaaaaggactgtagaaaccaactacagaaaggtatctatttacatttatctaaaccccaaaccaaaaaccctgatggtatagctagctatgtttttaaaagttcaattatgttaggaaagaaaaacagcaaggctactctaaaaagatggtctttaagagaatgacgaagaatgaccttttattatctactttgcagcaggcaatggcttagatgcatttacattcattatctcacctatgtgatgta

SEQ ID NO: 82188 - DNA, 601 bp, Human
cttaaaatatagctcagagttcactttctagaaggaacattattcctctctcaacatattcattcccccttcagtgtcacgcacacacgtatcctcactgaaggcagagactcccttgcgcatttctgtatctcagagaccaatgcagtacatggtacacagaaagaattctgcaaatgatttctgatcttagcgagtacagaacaggcagatgtgagaactttgatgaaaagagctgtgggcccttttacaattaatctttaaaccaaacctacagactttattataaataagatgatgmaactataagatttctttccttaaatctctggagagatataagttggtaagaacgtcctgataggaaatatgtccaacttaatgaatggtacttatatatttttcttcttaataaagctttaaaattaggataatcagtatgtttaacagaaatcattcgttaagaatcacagccttatgacattacattttattaaataatcgaacatacttgcaacaaatgctaatactgtcaactcagtcacagcaagtttttttttctgagaattattaatgtgaaattttaacttcaggctgatct

SEQ ID NO: 82189 - DNA, 601 bp, Human
gcatcacttgagcccaggagttgcaaaccagcctgggcaacatggcgaaaccctatctctacaaaaaatacaaaaattagctgggtgtggaggtgcacacctatagtctcagctactcgcaggctgaggtgggaggatcacctaagcctggggaagttgaggcttcggtgagctgtgatcacaccactgcactccagcttgggtgacagagtgagaccctgtctcaaaaaaaagagagagaattaactgggtgctgtggcacatgcctatagtcccagctactcaggagggttgaggtggraggactgcttgaggccaggagtttgaaggggtagcacaccatgattgcatctgtgaagagacactgcactccagcctctaacctggcacaggaagaccctgtctcaaaaaaaaaaaaaaaattgagaaagtatatgccaggtactggagaaatagcaattaagagattaagtttgccttcatgaaaaaaaggggaaataacaaatatataatttcaagtattttatataaatatacatatatgattatacataattttaggtaataaaaattctacattagtataaaggatgtatattag

SEQ ID NO: 82190 - DNA, 601 bp, Human
tacaaaaaatgaaaacattagccgagcatagtggcatgtgcctgccgtcccagctacttaaacctatttatccatttgaaattaggcaaacttcccaggtctcaggttgtctaatgatacaaaatgcagagacactatacgtcctatatcttgctcagagttattaagaggtgaaaggtaagaattagctggggctgggtgcagtagctcacgtctgtaatcccagcacttcgggaggctgaggcagacgcatcacttgagcccaggagttgcaaaccagcctgggcaacatggcgaaacyctatctctacaaaaaatacaaaaattagctgggtgtggaggtgcacacctatagtctcagctactcgcaggctgaggtgggaggatcacctaagcctggggaagttgaggcttcggtgagctgtgatcacaccactgcactccagcttgggtgacagagtgagaccctgtctcaaaaaaaagagagagaattaactgggtgctgtggcacatgcctatagtcccagctactcaggagggttgaggtgggaggactgcttgaggccaggagtttgaaggggtagcacaccatgattgcatc

SEQ ID NO: 82191 - DNA, 601 bp, Human
gcttgcagtgagcagaggtcgcaccactgcactccagcctgggtgacacagcgagactccgtctcaaaaaaaaaaaggaaaaaaaaaaagacccccatctctacaaaaaatgaaaacattagccgagcatagtggcatgtgcctgccgtcccagctacttaaacctatttatccatttgaaattaggcaaacttcccaggtctcaggttgtctaatgatacaaaatgcagagacactatacgtcctatatcttgctcagagttattaagaggtgaaaggtaagaattagctggggctgggygcagtagctcacgtctgtaatcccagcacttcgggaggctgaggcagacgcatcacttgagcccaggagttgcaaaccagcctgggcaacatggcgaaaccctatctctacaaaaaatacaaaaattagctgggtgtggaggtgcacacctatagtctcagctactcgcaggctgaggtgggaggatcacctaagcctggggaagttgaggcttcggtgagctgtgatcacaccactgcactccagcttgggtgacagagtgagaccctgtctcaaaaaaaagagagagaattaactggg

SEQ ID NO: 82192 - DNA, 601 bp, Human
ccccgaggagcggtaaaggagtattatggcccttcggatcctctcgttcatttgttttacaaacattcagtgcagcgacggctcagccccagcccctgccataaaggaaggagttcccagactagccagaaaaaaagtggaattacctcagtagcacacttttgataagcgctgtagtgaggatggatcatgataatatgggcctggctgcgggacaaatgacccatccatctggagaagcgagggcaaattctggatgcggcgatgccagagctgatgagcaggagttagctacgtaacmgaagcagaggcaaggccgttcactgcaagggagtcgcaaaggtgtgaaatagcctgacacttgggggcaagtgggtcattattcgggagacccaggaaattaggaagcaaagcaaaaaagctggagaggtgggtactgctaaggagtttgcactttatcctgaggacagtgggaagcctttgaaggagtgtaagcgaaaagttacgggttcaaatttgcattttcctaagatcattctagttggctttgtggagttgatggaatggaggcagggaggtcagttgtgaagctattgcagta

SEQ ID NO: 82193 - DNA, 601 bp, Human
cattctagttggctttgtggagttgatggaatggaggcagggaggtcagttgtgaagctattgcagtaatcccaggactagatgagagtctgaaagaagggcgaagagaggaatatttttcataagtatgggtgggcagagatgagagggggatgtttgtttacccaaagaactgaatggaagggtcctgtcccctggctagcatgctaactgggctgcaaggacttctgcaagagtatggagatcagtggctcagaaggcccttggcttatttgcaggtggactggcagaggaagtggaygacaaagttcttcatgctgcgttcattccttttggagacatcacagatattcagattcctctggattatgaaacaggtgagttagtgtctctcacgttcagaatcctcttactaggaaaataccttaaaaaattaaagtcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttg

SEQ ID NO: 82194 - DNA, 601 bp, Human
tcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttgagataagacagatttttcaatagaccagtagggagataggtttgaactacattgagatttgaatgttgttttaatctacctgatgggtaccccatcccacctgcaccttcttgcagctgtgctattaaatgaggcagcrggaaagcctagccccataatgggggtgggtgagggcgggggttcttggcctctgcacccctgggtgggtttcccatcgattggtatcacaaccacagttcagttttctgtttacctttgttgtcatttttaagattatagttttaggcctagttttatcatcaaccttgcatatgattgttagcaaagtctttaaactctctgggcctggggaatctttatttgcaaaatgataaggttatgttggctttctaagggccttctagtctctgagttctatgataaacattattgtgcttgg

SEQ ID NO: 82195 - DNA, 601 bp, Human
aaatattgtataagaagaatcaagaatgagattccttcttcctaaatagtgattggatagaacttctggtgtttggatacgacatgtaactgacttcactttgtgaccatcctgtttcttcccactaccccacatagtaattacttgtttttgtttttccattttgtagaaaagcaccgaggatttgcttttgttgaatttgagttggcagaggtgagagtctgtgttactagtgtctagtccttggtttgtgatgttgttactgattacaaaggaagcttttcaccatttggttaggttkttgggccttaggctgatgcttccagagagatcagaagtaagtgctgttctaaggaaagcgtctctcacataatcagactggactgtgaataacatgtcagacctgccaggccctcccattcttgccctgcagaggagctagctcatgcacccctgttcattgagcattcttgcctggaagtagtgattatttcttgtgccttcaactagatggcaaattgttgcaccaccagctctaaaatcagccaggaagtgctctttgttagaaacacacaaaacctaggcaagaaatacagaggtg

SEQ ID NO: 82196 - DNA, 601 bp, Human
gtgcaaagataccatactgttgatagaattttgttggaaaaataatacttcagtgcctgttacttttctttctttcttttttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtmatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggt

SEQ ID NO: 82197 - DNA, 601 bp, Human
aagggcatgcaccacctttttagagaaacaagtgagtttgagcttctcagcaaagccaaagtgattgtttctgttatgagagaaattcctgcctgagctcatctttcccagttttcttgatattccattcctggggtctccatcaagggctgaaatcagcaaaggctacacctttgctttcggcatagctattttccttagccctactgagagctggacttcagggcctacattctggatgggaactttccttacccctgggagttctcagtggggaattgtctggcatacaggccacatrgcatcttccactttgctgaccaaagcagctacttttcagttcaagctgacagcttgaatgaacatttgtttgattctttcctttcagtttggtcagatgatgactggttgaagaagttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatg

SEQ ID NO: 82198 - DNA, 601 bp, Human
gttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatgaataatgaattcttagtactttggtaaagtcaatattgagttcttagtactttggtaaagtcaatatcgagtgaattcaagggcgaaactttgggtctcttgtccatgttgtgttytatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgagaacctgctggggcacttccccctgattctcagcatagtctctgacagttgcttcctgggcgtcccctc

SEQ ID NO: 82199 - DNA, 601 bp, Human
gttgtgttctatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgagaacctgctggggcacttccccctgattctcagcatagtctctgacagttgcttcctgggygtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacg

SEQ ID NO: 82200 - DNA, 601 bp, Human
cttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtsgagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggagg

SEQ ID NO: 82201 - DNA, 601 bp, Human
tatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttytatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcct

SEQ ID NO: 82202 - DNA, 601 bp, Human
tttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatrggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccg

SEQ ID NO: 82203 - DNA, 601 bp, Human
ctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaatycctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctc

SEQ ID NO: 82204 - DNA, 601 bp, Human
agagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactscagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggttttttattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttc

SEQ ID NO: 82205 - DNA, 601 bp, Human
atagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggtttttwattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatg

SEQ ID NO: 82206 - DNA, 601 bp, Human
tcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtrctgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcac

SEQ ID NO: 82207 - DNA, 601 bp, Human
ccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccarcctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagc

SEQ ID NO: 82208 - DNA, 601 bp, Human
gctatcacccatgcccctggtcccccatcttttttcaagaagtaaaagcataacttcttgaaaacatggtacagacttgctgccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcrttatacttaccagttgagcatcccaaatctgaatatctcaaatctgaaatgctcgagtgagcagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcc

SEQ ID NO: 82209 - DNA, 601 bp, Human
gccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcattatacttaccagttgagcatcccaaatctgaatatctcaaatctgaaatgctcgagtgagcagttcctttgagtatcatrtcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatac

SEQ ID NO: 82210 - DNA, 601 bp, Human
gtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctrtaccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccag

SEQ ID NO: 82211 - DNA, 601 bp, Human
ttaggtgcagataactgtaaacacattttttacctataccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcytagcttcaagtgatcctcccacttcagcctcccagagtgctgggattacaagcattagccactgcgcccagcctctagcaggatgtttgtaagggccaagaggatatgagacaattcattgtgccagacattgcagaacatctagcattccaggcccccacctgctaaatgccagtagcacccccacaatatttcagacagtcaaaaacactttcaggccaggcacggcggctcatgcctgtaatcccaacactttgggagtctgaagtggcagcccaaagccagaggatcacgtgagtt

SEQ ID NO: 82212 - DNA, 601 bp, Human
aggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctcacttctattctgccacaaaggcccagggcagcaaggacgggaagccaaagcagaaggtgatcatcgccgactgtggggagtacgtgtgaggcggcactctctctgcttccccctccgctcttgaccytgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctag

SEQ ID NO: 82213 - DNA, 601 bp, Human
aagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccacyggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagc

SEQ ID NO: 82214 - DNA, 601 bp, Human
agagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccascactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaac

SEQ ID NO: 82215 - DNA, 601 bp, Human
ttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcrcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgt

SEQ ID NO: 82216 - DNA, 601 bp, Human
ggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcrgttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctggg

SEQ ID NO: 82217 - DNA, 601 bp, Human
tgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgcygactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaacct

SEQ ID NO: 82218 - DNA, 601 bp, Human
cttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccarctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgat

SEQ ID NO: 82219 - DNA, 601 bp, Human
aagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgtycacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagcccca

SEQ ID NO: 82220 - DNA, 601 bp, Human
tggtggggcaacatggtggcagatagatgggtcaattggaagccccaagatttttctgtttctccaaagtaaaatgtccatgctcttacatgtctttcctagatggcagaggcaaatgcaaagcaggaagacaagggaagataaatgccattggctttagccctaaatcatgctgttcactcagctttttcttgagttgactccacatgtctacctgtgaccagtggatcagtgcttcagatccatgaatatacaatacttcaggggttatccagttttataccccaccttgcacctcggscaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggca

SEQ ID NO: 82221 - DNA, 601 bp, Human
tgtctttcctagatggcagaggcaaatgcaaagcaggaagacaagggaagataaatgccattggctttagccctaaatcatgctgttcactcagctttttcttgagttgactccacatgtctacctgtgaccagtggatcagtgcttcagatccatgaatatacaatacttcaggggttatccagttttataccccaccttgcacctcgggcaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggcaatgccccggcctggggtctgg

SEQ ID NO: 82222 - DNA, 601 bp, Human
gacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggcaatgccccggcctggggtctggctgggtttgagggtttcctgcttctgaggggcccratccagatgagaagggtggctgcagctgggccgggcgggtggactcagtggcagccgcaggccttgaccaccatgttgcggtgcttgcgcaggatgacattgttgctgctgtcatagtagagcacagaggtggcgctcagcttggtgggtgcacagcacgccttggggactgcgtctggcatcatcaggtgcacctggccaggaagagggcacaggcaggggcatgagcccagtggcctcctccaaggacccacccagccccaccccagctccacctgctccctgccctggccatctcca

SEQ ID NO: 82223 - DNA, 601 bp, Human
cagggagggacacatggcagggggtgtgcagcaggtgggcaaggcgctaatgaggggcctggagtcccaggccaagggctcagacttcctcctggggataatgggaaggagaactgtgtggccaggtttgtgcccttagtgaggtccccaagggggagcctggaaggaccactttcttcttttggcccttcggacccccagaggctctgcctcccacaccctggcctccctccccagtctctgggaggccaggcctccgcccctctcctgtgctgctccttcccccagaggactgcatccrccctcagcacttcaaggccctgcacgtgcccgcacctctccactccccaggctcagcttggacctctcttctgaactccagacttgtggatcctgctcccctcgccacttctgcacttggggtctaatggggcctcagcggaacatggagttcctcccgccctgacatcatagcccccgcctgggaggcctcctggatgactcctcttgcctcctcccttccctgggagcagcccctggctcaacctccacctccatgctgccttggaccacctgccccgtccagctgccatcacctgtc

SEQ ID NO: 82224 - DNA, 601 bp, Human
agctgccatcacctgtcaggtgaccacagcagccttcactcatcccctgctcctccaccttccaccaccacccccacccccaatcccagcctcccccagcagccagagagaggtccttctggagggtgacatggaccagaacactgctttgctaaagagctccgacagcctcttgggttacttggaataaaacaccttcattcagacccccaggccctaggggagccggccctgcccaccctggtgtcacctccctccgccctcctcccactcactgcacccagccccttctccctgctgrccctgaacctgccaagctcactgctgtcttagggccttggaattgctccttctgctggaacattcctcctccagctgctgactggccccctccttctgtggagaggccaggcccagtctctccccactgatggagcagccactctgctcttcctcacaggaggcgtcacctccacggttgttttgctttggacaaaccaacaaaccgacagcctcccctagagcgcagcgcctgtctgtttgctgcccagcaggttacgagtgctcactttagttgagcccctgaggggcaggggcaagg

SEQ ID NO: 82225 - DNA, 601 bp, Human
gatccacccacttcggcctcccaaagtgctgggattacaggcgtgagccactgcgcccagccaccattcgaacgattttcaagtgtacagttcagttgcagcaagtacattcatactgttgttcagccatcaccaccattcattgccccaactctttcacttttccaaactgaaactctgtctccgtcaaacactaactcatcttttcccctccccccagcccccggtacccaccattctacattccgtctctatttggatgactctagggactcctataagtggcattatgcagtatgcrtccttttgtgactggcttatttcactcagcacaaggtcctcagggcccctccgtgtcactccctgcatcggaacttcctctctttttaaggctgggtactattccatcatctgtatacaccacatttgtttatccattcacgacatttggattgttgttgaaatcccactcgactgcacactcctgctgccagccgcgtgctgggcacagggcacgtgctctgggtcagctgctgagtatgggacacagctgagcatactcactctctctctgaccccaggacactccctctctgatcac

SEQ ID NO: 82226 - DNA, 601 bp, Human
tgatgctgtgttcacttggatttctgcctcatttccagggaattcagaatccgtttttttcgattgtcccttagatgtccacgtgttttctggttctcttttcacctgccatacatttctatgaattatttcacctactattatagcaccaattgccacttatatctgaatgattttcaaattgaagttccagctccagactcaatatccacttgccctttgggcacctcgacttaaatgtgccacaggcgccttattggactaccaccacctacacacacacctgtgcacacacctgcaygcacacacacctgtgcacacacttgcacgcacacacctgtgcacacacttgcacacacacacacctgtgcacctgcaggcacacacctgtgcacacacctgcatgcatacatacttgcacacacagttgcatgcacacacacctgcatgcacatacctgcacgcacacacacctgcatgcacatacctgcatgcacacacacctgtgcacacacttgcatgtacaacttgtcacacacctgcacacacacacctgtgcacacacacttgcatgcatacacacctgtgcacacacctgcat

SEQ ID NO: 82227 - DNA, 601 bp, Human
tctttgcacatgtctgctccctttctgctttccatgagtggaagaggcatgaggccttcatcagatgcagctgctccatcttgagctttccagcccccagaatcatgaatcaattaaacctcttctctttataaactacccagcctcaggtatattgttacagcaacattaaacagacaagactcaaatctgctggatacatgaatcagctggcaaaagaagagcatagagaattcagactatagaatatgtcctcgattcattttaatgggctctggtgcacccagctgctgcagaagcygctaccgatggctcacacctgcaacctttttagcaggattgttcttgggtgatcaaagccatctcagctggaggtgcatctcccttgtcctgggacatcctataactaaagcctgtcttgtgtgagggcacaaaatccagctgtcttgcctcaaggtagggcaaattctggggcaatttacagcaccaatctcctctgctgtcacaggctgagagtggatctcatctgcaaccacatctttgctcagcttcttcttcctttctctcaccctcttacaggttccttccgagagcactccct

SEQ ID NO: 82228 - DNA, 601 bp, Human
aacccatgttgcaatttgatcccccaatgtggcagtgttgagaggtggggcctagtgggaggtgtttgggccatgggggcaggtccctcatgaatagattaataccctactgcaggggtatctcacaggaatggattagttcccttgagagcaggttgttaaaaagtgcctgtcttcctcagtttctctctcttgccaggtgatctctttgcacatgtctgctccctttctgctttccatgagtggaagaggcatgaggccttcatcagatgcagctgctccatcttgagctttccagccyccagaatcatgaatcaattaaacctcttctctttataaactacccagcctcaggtatattgttacagcaacattaaacagacaagactcaaatctgctggatacatgaatcagctggcaaaagaagagcatagagaattcagactatagaatatgtcctcgattcattttaatgggctctggtgcacccagctgctgcagaagctgctaccgatggctcacacctgcaacctttttagcaggattgttcttgggtgatcaaagccatctcagctggaggtgcatctcccttgtcctggga

SEQ ID NO: 82229 - DNA, 601 bp, Human
gccccccaaatgcattttcacacaactctattggtaaagaagtgtcccttattagaattaaacgacatttgctttcttccccgcaccggctgttacataggtagaaagtgttcagagtcttgatttggttgacttaaggcatgggaaataaaatggacaaagagaatcattttcctaacctctgcttctccacatcagacttctaaatccacgtccgtgccatttctatttgatgtcccaaaggaatgaaagaaaatgtgccccagatggaactgaggtttcatcccagctctacttctcygtccagtgtttttctaatttaatgacactgtcatccttcttttcatgccagaaactggagagtccccctagagtcctcttcccacacgccacatatccaggctgcacttttataatgaattccttcctctgaatctccactcctgtggctgtaattcagccttttgtcacctctcactgggctactgcagcactttactggttttctggtttagtcttttccgcataaattccagcctctagcctgttactagagtaatcattccataaaatgcaagtctgttgctgggcgtggtggctc

SEQ ID NO: 82230 - DNA, 601 bp, Human
tccttttataatcagaggaatgtcatttttaaaaggtttgagttgtggtgtaatacacatagcatagtttgccatcttaaccatttttcagtagacagtcagtagcattaagcatgctcacactgtggtgtaaccaatctccagaacttcttcatcttacaggaatgttgtttttaaaagagagaaccaaatacttctccagatgtatgtgttttgaaaaatcaaatgcaaagtaagtaatggcttaatcagaccgaaccaccataattgaatagcctgaccaattcgtgaaagaactagycatgggcctttcactgtctttttttgtttttgtttttgtttttctgagacggagtcttgctctgtcacccaggctggagtgcagtggtgcaatcttggctcactgcaacttccgcctcaagcaattctcctgcctcagcctcctgaatagctgggactacaggcacaagccaccgcacctggctaatttttatgtttttggtagagacagggtttcaccatattggtcaggctggtcttgaactcctgacatcatatgatccaaccccccaccttggcctcccaaagggcttttgattca

SEQ ID NO: 82231 - DNA, 601 bp, Human
ttccatcttctgacattggatctaggtggtttatttaaaaagctgggtctttatgattttgttttgcatagacttaaaaaaaatttgtgtttgttttatccaggccatagattcctgctctactgctctttttgcctcctgcttctgtttctcagaaaaatagaaaattgactttgctttgttcaggggagtccatggcatgtccaccactcccatttaagtcaggttaacagggtaaatgctgacgatgcactgagtctactggttctaaaagccctttgtatttgctttaccaccttayaaaaaggcatggatcagtatttgtgttgaccttgaggcttttcttctcacaccacgcagatatcttaacacaggggttcacacatggtgaccgggcagacagatgcgtgtgaaactaatgtgtagactaaatgcaatatacagttaatgcctggtgggaaacagaattttcctttaattgcccatttgtaagattgaataagtaggcaggcagagtgtaaacacagccccatctatagacgtgtgtcttgggaacagaaaggatcacacattcttaagctaagacaaaggctttagtttg

SEQ ID NO: 82232 - DNA, 601 bp, Human
tactgatgacaatgatctgctgagtcaagtcagaatgtgattcagtaagattggaggggaagggaatgcaatataatggatgggtacagtattgctggtactgtgttgagctgcaggaagattttgctgactttcttgagaagtgaggggatctggtgcctgagcaatcaaccatgattcatagtaacttgctacagtgctgtttgaacagaaataaaatttgacctttttctatgcacccaagccactcaacaaaatatatttgtaaatacaattccatcttctgacattggatctaggyggtttatttaaaaagctgggtctttatgattttgttttgcatagacttaaaaaaaatttgtgtttgttttatccaggccatagattcctgctctactgctctttttgcctcctgcttctgtttctcagaaaaatagaaaattgactttgctttgttcaggggagtccatggcatgtccaccactcccatttaagtcaggttaacagggtaaatgctgacgatgcactgagtctactggttctaaaagccctttgtatttgctttaccaccttataaaaaggcatggatcagtatttgtgt

SEQ ID NO: 82233 - DNA, 601 bp, Human
atatttaggccaggctcggtggctcacgcctgtaattccagcactttgggaggccgaagcaggtggatcacttgaggtcaggagttcgagaccagcctggccaacatggtgaaaccccatctctactaaaaatacaaaaattagctgggcatggtggcaggcgcctggaatcccagttactggggaggctgagacaggaggatggcttgaacctgggaggcggaggttgcaatgagctgagattgtgccactgcactccagcctgggcgacacagtgagactccatctcaaaaaaaaaagrgggggtggttattcatcagctgttaactgattttaattaagattttgaagaatattctcaaagtcaaattgtgtgaccatagtgtatataaaatgaagacagcaaacatcgcctatggaagaagacataggttgggctcaaagcttgcacctttcctctctcggcagttctggctctgagtcccagctatgccactgactcactgctggactgttctgtgtgtcagtctctaagcctcgtgccaatgtccactgtgtgcctggtataggtcttggctcaggctaggtggcaataaatgct

SEQ ID NO: 82234 - DNA, 601 bp, Human
acctcaaaagcatatttaggccaggctcggtggctcacgcctgtaattccagcactttgggaggccgaagcaggtggatcacttgaggtcaggagttcgagaccagcctggccaacatggtgaaaccccatctctactaaaaatacaaaaattagctgggcatggtggcaggcgcctggaatcccagttactggggaggctgagacaggaggatggcttgaacctgggaggcggaggttgcaatgagctgagattgtgccactgcactccagcctgggcgacacagtgagactccatctcaaaaaaaaaagggggggtggttattcatcagctgttaactgattttaattaagattttgaagaatattctcaaagtcaaattgtgtgaccatagtgtatataaaatgaagacagcaaacatcgcctatggaagaagacataggttgggctcaaagcttgcacctttcctctctcggcagttctggctctgagtcccagctatgccactgactcactgctggactgttctgtgtgtcagtctctaagcctcgtgccaatgtccactgtgtgcctggtataggtcttggctcaggctaggtgg

SEQ ID NO: 82235 - DNA, 601 bp, Human
gtcttaggtagcatgtgtaaataaataaaaaatgtgttttctcttttgatgttgttgtttcctgatttaagaatgaaaggtaacttgattgtattggatcagtagtttgattcaagtaacatcgtggaattcaaaagtgcaaaggtaaaacctcaaaagcatatttaggccaggctcggtggctcacgcctgtaattccagcactttgggaggccgaagcaggtggatcacttgaggtcaggagttcgagaccagcctggccaacatggtgaaaccccatctctactaaaaatacaaaaattagctgggcatggtggcaggcgcctggaatcccagttactggggaggctgagacaggaggatggcttgaacctgggaggcggaggttgcaatgagctgagattgtgccactgcactccagcctgggcgacacagtgagactccatctcaaaaaaaaaagggggggtggttattcatcagctgttaactgattttaattaagattttgaagaatattctcaaagtcaaattgtgtgaccatagtgtatataaaatgaagacagcaaacatcgcctatggaagaagacataggttgggctca

SEQ ID NO: 82236 - DNA, 601 bp, Human
atatgggatatgagttaaaggaatgttcttgtcactaaatgtgctcaaatttcccttcacccgaagagcaagtagccagtgtctgtactaagttagacctgagggaaggaatgattattttattttattttattttatttgagacggagtctcattctgttgccgaggttggagtgcagtggtgtgatcttggctcactgcaacctccacctcccaggttcaaacgattctcctgcctcagcctcctgagtagctgggattgcaggcacctaccaccacacctggctaagttgtgtatgtytagcagagatggagtttcaccatgttgtccaggctggtcttgaactcctgatctcaagtgatcctctcaccttggcctcccaaagtgctgggattacaggtgtgaaccaccgtgcctggccaagactgcatttttaagttgcaagtaatatggtgaaaaattagtgtgtaccaacttttgtcatgttggttgtgcttgatatggtttggatctgtgtccccacccaaatctcatgcccaattgtaatctccagtgttggatgtggggctggtaggaggtgattggatcatgggggcggtt

SEQ ID NO: 82237 - DNA, 601 bp, Human
ttaacccaaggcaacatagtgagacccccgtctctttaaaaaacagaaagaaaggggaaaaatcaggtatgtgagagaggaccaggatttttttttctttttttcctttttatgatcagagactacataataaagaaatagagtgtacatcttcggatgcctcttgaccgaaagacgtagtcattcatatgggatatgagttaaaggaatgttcttgtcactaaatgtgctcaaatttcccttcacccgaagagcaagtagccagtgtctgtactaagttagacctgagggaaggaatgaatattttattttattttattttatttgagacggagtctcattctgttgccgaggttggagtgcagtggtgtgatcttggctcactgcaacctccacctcccaggttcaaacgattctcctgcctcagcctcctgagtagctgggattgcaggcacctaccaccacacctggctaagttgtgtatgtttagcagagatggagtttcaccatgttgtccaggctggtcttgaactcctgatctcaagtgatcctctcaccttggcctcccaaagtgctgggattacaggtgtgaaccaccgtg

SEQ ID NO: 82238 - DNA, 601 bp, Human
tttgatctacagatcaatttgggaagaaatgacaacagtattaagtgttccaatccatgatcatggcatatctttccatttgtttagccctttgatttctctcagcaatcttttgtagttttcaccatggaggtcttacatatcttttgttaaatttattcctaagtatttattttttgatgctctcataaatgaaattgcttataaaatttcatttcccaattgtttgctgttagcatataaaaatacagtggattttcatacattaaccttgtatcctgtgaccttgctaaattcactygtaagttctagtggtaattttgtagatttcttaggatttttctgcataagtaatcacatcatctactgcctcttaaattattttgcaattccccgatactgtataattttagctatgtgttcagtgtattatacataactctgattcttatcaaaatgtatcattttagttattccttggctcatacatataaaatatgtactatatgttacacatatatgtaatattacagattacctatgtcatattacacatggatagatggatatctgctgctttcagctcacgtgcacaacctca

SEQ ID NO: 82239 - DNA, 601 bp, Human
tggattatttttctgtaggatgaaatgcaaattaagtccggtaaaattctgaaatgcaccatttgttaccaataaatacagacaaacacttttaatgacaatgactatgaacgcgttctcttccagctaacatgtttgtgaaatgctgcagtgaatctcaaagataacaggcacccggctaattctattgggttaacacgtccatgctggctgtgcaggcttatttaagtaattgcctgactgtgaatgaacagaggtattaaagtaaagttggcacaagggacagcatccacatggcacrttctttgtttcgagagctttattctatcaatactcctggaaaaaagagaagttgctaaataaataatggaagcacacaagacagtgtgaacgccttttcaagtcctcgaattgtcaagcatcttatataaagttctttcccgactctgagctcatcacatttcattttacatattaattttgcgtaagagcaagctcatcccgttcaaatgttaacagcttcaaaataagatcctggtgaaagctcgtcacattccattttaaatattaattttgccaaagaacgagctcatgcctttca

SEQ ID NO: 82240 - DNA, 601 bp, Human
aggctggtcttgaactcctggccttaagcaatcttcctgcctctgcctcccaaagtgctgggattacaatggtgagccgccacgcccggcctggattctactttggaaaatctttgcaagtgaagaagaataggacagaatggctgaactgggatgaaataagcggcaaatgaggaggaagaggagagacagtcagtctggcaagacactctctgctaagaagcgggtaaaatcaccacagcaagttatcaaaaacttgaaagagcccagctcctccggcagctgggagagaatgcggacygctctaaagaggctgcagacttcatgaagtggtaccagagtagagcaggtttattaatcacggataaaactgctgaataattacctacttcaaaaagcattcatgagttgtgtttaggtgcttacaaagtactttgtgcttggtcctggccagtaagttagttcaaggcagttaatatagataaacacaaacacagcaaagacgtggtcggtgtaacaattacaaatgtaaaaagcaaacacagaaagggattgctggctgggcaccgtggttcatgcctgtaggtcccagtagttaggg

SEQ ID NO: 82241 - DNA, 601 bp, Human
ctaaaaatacaaaaattagccaggcatggtggtgcatgcctgtaatcctagctactcaggaggctgaggcatgagaattacttgagcctgggaggcagaggttgccgtgaaccgagattgtaccactgcactccagcctgggcaacagagcgagacaaaaataaaaagagagaaaaataaagcaagattgaggcacgttctggaaagaagattctatttcgttgttgtcattttgtttttgttttttggagacatgaaattactccaggctgaagtacagtggtgcaaccacatgcgctcrggtgatcctcccacctcagcctcccaagtagccggaaccacaggcgtgcaccaccatgcctagctaatttttaaaattttttataaagacggggtctcaccatgtttcccaggctggtcttgaactcctggccttaagcaatcttcctgcctctgcctcccaaagtgctgggattacaatggtgagccgccacgcccggcctggattctactttggaaaatctttgcaagtgaagaagaataggacagaatggctgaactgggatgaaataagcggcaaatgaggaggaagaggagagac

SEQ ID NO: 82242 - DNA, 601 bp, Human
agtctcttatctacgaggagtgtgtgaactcagcagggaagggtagagtttggaaagcagataatcacccgagccttctcgtgccctaagtaatgatcgacaagtaccagactgtgcccacacacctgccactttgatatctccaccagcagaggtcagtgccccgcagtagagtcaagaaacctgcaagttgacgcttggctgtgagagtcaagggacaagggaataattcaatagatgaccacaaatacacagggaggcaattctcccttaagcaagttccagcagcttctaagccttsttttcattatactcccctccctgagtcttttttatacattctcccccaactgtcctacccccacgacattttaatagcacagatatactgtgtatttgttcatgtgccgtggccctttgggtggccaaaatccactgtaacagctgcaatttttttgtctcccaacaagaaccgatcttcacttactcagggtgttactcactccagttgagaatgaatgagttttgagtgaacacacatttttgttttgtttatttgtaaagagtgattattggttgctttggggtctgatttttaagc

SEQ ID NO: 82243 - DNA, 601 bp, Human
ttatgtctttgtaagaaataacattgaccacctgaagtatggcaagcctaggtgccacagtaaaagcataagctccaaaatacatacgttcatttgtgtgacaaatgtttactgaaaaccaagtttcactcatcccagtggcctcaagacctggcaaatattaagatttcagtctccatcctcacagagcttacaatgtaatggcaaataaatgggaggggctactgggaaacacaaagaagtgcgtccccctaacagcacctatcaattgtgagggatcatgagatagcatgggaagtcytcatcggggcttctgggaaggcttccctgaggaagcgacatctaacctgagacttggagaaaacgagcaggtggccaaaggagaggaaggaatgattcaaggagcaggagctgtctgtgtaaagtctggcaggcctggaggagcaaggcagtttgaggaagctgatgaaggccagagtagctggagggaaatgcagggaggaaagaggcaccaggtgaggctggggagggaggagaagggggcaaggagggcgtgccgggaagtgcggactcctacaggcaaaggaaaagtaccggaggc

SEQ ID NO: 82244 - DNA, 601 bp, Human
gggtaaataagcgtcttacaatgcgcatgtgtgtactggggaggaggtcttgacggaacaatgaaacattccacttccaagaaaatgtggaaaatgattcataaaataacaacttattgctagcaacttcctgtcagttacaaatgaccaaagtacaacctaaaataaaatgaatcagttagcatgatgttcagaaacctcattgatgttatataaattcagatacatgggaaacagctccaagtgggacagaaggcagcgtgtgtgtgtgtgtgtgtgtgtgtgtacatatatatatatwttttttttcagataaggtcttgctctgttgccccagctagaatgcagtgatgccctcatggttcagcacagcctcaacctcctggactcaggaggcatgggactcacctcccatgtctggctaattttctgtattatttatttatttttatagagagagggtttcgccatgttgcccaggccgatctcgaactcctggactcaaatgatccatccaccttggcctcccaaagtgctgggattacggggtgagccacagcacccggccgtggcagcatattaaacagattaaaaagtgact

SEQ ID NO: 82245 - DNA, 601 bp, Human
tcattctgatgaattcaagatgggcacttcatccaagtccccgcaagtgtcctgaagtttgagactctgacaaaaggctatcctaactcacaatgaaacactggagtttcgcagagattacacatacatccataaatgtgtgcacctctttggggttttgcaatataatggatctttctgttgtgcgtcctctgacagtttctactatggcgtgccattgtttttacactgtgtgacagcactgacaagaattactactgcaaatcaaaacacaaaaaaaccattggcagagccattacartaagtcaccaatagaagatgtcaggtagcaagccagtgttcaccaatggggactactcaaggtactcccagttcaaatgggaggcaatggagaagacagaagcatctagaccaaccctaggtcagaattgttactgcctttcttgtgagcttgaacaaattgatacccttgagcctgaatttcttcatttgtaaaatggtgacacaccatctttcctgagagcatttctcaggaacagggataagcacaaacatccaatcgcaaaagctgccaactatatgtggcatacatacctgtgtc

SEQ ID NO: 82246 - DNA, 601 bp, Human
acctttgtagttgatttcactgatctatgtcatttcagtagactttaggagggaagagaggtaagtgaatatattcagcaaaccgctgagtcacaagagtggcagagcaatttggtgaattcattctgatgaattcaagatgggcacttcatccaagtccccgcaagtgtcctgaagtttgagactctgacaaaaggctatcctaactcacaatgaaacactggagtttcgcagagattacacatacatccataaatgtgtgcacctctttggggttttgcaatataatggatctttctgytgtgcgtcctctgacagtttctactatggcgtgccattgtttttacactgtgtgacagcactgacaagaattactactgcaaatcaaaacacaaaaaaaccattggcagagccattacaataagtcaccaatagaagatgtcaggtagcaagccagtgttcaccaatggggactactcaaggtactcccagttcaaatgggaggcaatggagaagacagaagcatctagaccaaccctaggtcagaattgttactgcctttcttgtgagcttgaacaaattgatacccttgagcctgaat

SEQ ID NO: 82247 - DNA, 601 bp, Human
ccactttactgacttatccaagaactaagtttttgtttttattaagcatgactacctttgtagttgatttcactgatctatgtcatttcagtagactttaggagggaagagaggtaagtgaatatattcagcaaaccgctgagtcacaagagtggcagagcaatttggtgaattcattctgatgaattcaagatgggcacttcatccaagtccccgcaagtgtcctgaagtttgagactctgacaaaaggctatcctaactcacaatgaaacactggagtttcgcagagattacacatacrtccataaatgtgtgcacctctttggggttttgcaatataatggatctttctgttgtgcgtcctctgacagtttctactatggcgtgccattgtttttacactgtgtgacagcactgacaagaattactactgcaaatcaaaacacaaaaaaaccattggcagagccattacaataagtcaccaatagaagatgtcaggtagcaagccagtgttcaccaatggggactactcaaggtactcccagttcaaatgggaggcaatggagaagacagaagcatctagaccaaccctaggtcagaa

SEQ ID NO: 82248 - DNA, 601 bp, Human
tagccttacggaaggagctgggaagtgctccatattttcctatgttctaaaataatttaaataaggcattaactgttcctgaaaagttttacagaattcatccataaacaggctgaatagaatggtatgctcttctgtagcagaagaggaataagacctttcattatcttatttaaaaaatagctttgttggggctgggtgcaatagctcacgcctgtaatctcagcacttcgggaggctgatgtggaaggatggcttgagcctaggagttgcagaccaacctgggtgacagagtgagacmctgtcacaaaacaaaacaaaacaaaacaaaaaaccaacaaaaatagtttgagatataattcacattcacaggttcgccaatttaaagtgtaccatctctgttgcccaggctggagtgcagtggtgtgatcctggctctctgccacctccacctcccaggctcaagcaatcctcctatctcagcctcccaagtagttgggaccacaggcgtgcaccaccacacccggatagtttttgtattttttttgttgagatggggtttcgccatggtgcccaggctggtcttgaactgctgggctca

SEQ ID NO: 82249 - DNA, 601 bp, Human
tcttgaactcctggcttcaagtgatccttccaccttggcctcccaaagtgttgggattacaggtgttagccaccacatccagctccttaatagattaaaaaaaatttttttttaattaaaaaaattaaagatggggttttgtcatgttgcccaggttggtctcgaactcctgggctcaagtgattcacccaccttggcttcccaaaggcctgggattacccgatccacccatcttgacttcccaaagggctgggattacctgagccgcccaccttggcctcccaaaggcctgggattaccrgcaagagctaccttgcccagcctagatttcttaatcaacagaagaatacttgcatttctaagataaaccttacttgaccacaatatattcggcttttaatcctgcatagctagtgtttgtttaggagctttggccacattttaaatgtaagactgatcgcttgttttcttctttgtgtgctatcttcctctggctttgatttcaagatcaagctagccttacggaaggagctgggaagtgctccatattttcctatgttctaaaataatttaaataaggcattaactgttcctgaaaagt

SEQ ID NO: 82250 - DNA, 601 bp, Human
acagctgctgcccccgctggctgtcatgaggtatacttttagctacttaaagaagtttcctcatatccctggtttattaacgatttttaaaaaggaacatatgttgaattttattaattgctatttcagtatctactgagatgactaccagtttctctcctttatcaacaacattaattccttaggcaatttcttctttttctttctctctctcattctttctttctttctttagagataggatcacattatgttgcccagactggcctcaaactcctgggctcaagagatcctcctaccrtggcctcccaagaagctgggactagatttctcaatagatggctttgtttttttgttttgttttttttttgagataaggtctcactctgttgcccaggctagagtgcagtggcatgatcactgctcactgcaacctcaaatggccaggctcaagcaatcctcctgtctcagcctcctgagtggctgggactacaggcatccgctaccatacctggctaattttttttattgtttgtagagatgggagtctcgctatgttgtccaggctggtcttgaactcctggcttcaagtgatccttcc

SEQ ID NO: 82251 - DNA, 601 bp, Human
attaaaaaattgtataaaataacttcagactatgtatataaggtatatatgaaacatgaatttcgtgtttaaaattgagtcctcatccccaagatatctcattatgtatatgcaaatattccaaaatctgaaaaaaatcagaaaaccggctagacgcggtggctcatgcctgtgaaatcctagcactttggaggggccgaggtgggaggatcacctgaggtcaggagttcaagaccagcctggccaacatggcgaaaccccatctctactaaaaatacaaaaattagctgggcatggtggygcatgcctgtaatcccagctactcgggaggctgaggcaggagaatcacttgaatccaggaggcagaggttgcagtgagccgagatcgcgccactgtactctagcctgggtgacagagcgagactccgtctcaaaaataaaaaataaaaataaaaataaaaataaataaataaatcagaaaacctaaacatttccagttccacgcatttgggagactcaacctgcaccaggaattatacagctgctgcccccgctggctgtcatgaggtatacttttagctacttaaagaagtttcctcat

SEQ ID NO: 82252 - DNA, 601 bp, Human
agtgagcgtcagctaccacagtcccttcttgcagggtgttcctagtttaatccttatctgtacttgtgaaatggaaggtttatgccttgctagagagcttttaggtataaggcttgtcaactctaaaatcacactgcagagacctgcagtgtgcctctcccctactgacccacacaggtaggggacagagttggaggccccaagcacagagccctgcctaggcaagacactgccactgctgctcactgtgaagcaacctggggaaccccctgcttccacctgttctgtcccatcagcaggygtaggggctgctgccatggtctggttctgccccccatcactccaactctgtgcactgcctggcggttgtcaccagtccaggggtctgaccagcgtacccacctctgcctgctcaccttcatagtgcacagccccatttctaagatgatgctcagcgagtgaccgtctatgggaccattcccaaaggcacaggtgcatggggaaccccaagaaatagtgcaataacctgaagctgttaccagccctagacctggggtgaggaacagttacaaaacctggaaggagagagtttcaggtagag

SEQ ID NO: 82253 - DNA, 601 bp, Human
agcgacaccagcatcactaaaggagctgaattaaatgcagtgcttttgactttggacttacatgcagagagaaagaggagagttgagtaacatgctcagcctgtctctccccaggatgcccatcctctgctgaacctgcccgcaggtttgggagccgctgagtgcactgcagagtgagcgtcagctaccacagtcccttcttgcagggtgttcctagtttaatccttatctgtacttgtgaaatggaaggtttatgccttgctagagagcttttaggtataaggcttgtcaactctaaaaycacactgcagagacctgcagtgtgcctctcccctactgacccacacaggtaggggacagagttggaggccccaagcacagagccctgcctaggcaagacactgccactgctgctcactgtgaagcaacctggggaaccccctgcttccacctgttctgtcccatcagcaggcgtaggggctgctgccatggtctggttctgccccccatcactccaactctgtgcactgcctggcggttgtcaccagtccaggggtctgaccagcgtacccacctctgcctgctcaccttcatagtgcac

SEQ ID NO: 82254 - DNA, 601 bp, Human
cactggggtcagaatgccaaggaggacttccccatctggaacccacacacagagagcagcggagtgctgatcgatggttacacccctcggcatcttcctctctgtattctatacccattatgcgaagattttgtccacagaaccaccttcgtttactaagcaatgcttgctgcggtttcaaaggtgctcagatccagggcggtgcagcgcttgccagaggccgccctgttccaggatccgttcctcagcttcatgcttaattttgtaaccatcagtcttctagggacttggtgattcaagygaaataaatcagtaagtgatgaggaaactgaaatatcaattaagtggtaaagagatggaggccaggttagtgagcacagactgagaaaggaatgatctgatccatgagtgaggcgtggatccagcagagccgagcccaccccatcccaccaggacaagtggcaggaaccgcagggaaagctggaaacacaacagctttcttagaaaagacgttggcgcacttacgtggggtggtccagatctcacactcatcatctcagacaacattaagatggtaaaaaagcagtctcgggccgggcac

SEQ ID NO: 82255 - DNA, 601 bp, Human
gcagtgaactgatatcgcgccactgcactccagcctgggggacagagcgagactccatctcaaaaacaaaaaacaaaaaacaaagccttagtgtgttagcatattataaatattttttcttttcttttttttttttttttttttgagatggagtcttgctctgtcacccaggctgcagtgcagtggtgcaattttgccttctcctgggagtggtgcaacctccatctcctgggtttaagtgattctcctgccttagcttcctgagtagctgggatttcaggcgcccacccccatgcctaastaatttttgtactttttttggtagagatggggtttcaccatgttggccaggctggttttgaacctctgaccgcaggtgatccgtccaccttggcctcccaaagtgctgggattacaggcgtgagccaccacacccagccaatattttcaattcaaagttgagaaaatggccacagggagctctaaataagtcattttttatattctctgcttttaagtcaaaagaaggaacagagaagagatgcgtgcagggtgggagcagagcacactggggtcagaatgccaaggaggacttccccat

SEQ ID NO: 82256 - DNA, 601 bp, Human
acaaacttttacaaatgcaacatctaagtttaaatgcaagcaattataaacactaaattgaaatattggaagtatttctcctattaaaaacaaatctgattacataatatgcttgtttggtacctttgtttgtttttttgagacagggtctcactctgccacccaggatggactgcagtggtgcgatcatggctcactgcagccttgaactctcaggctcaagcaatcctagcagctgagactacagatgcctgccattacatctggctaacttttttattctgtatttttttttttgtaktgatggggtctcactatgttgaccaggctggtcttgcacttttggcctcaagcctcagccttccaaagcactgtggttataagcatgagtcactgtgcctggctgctcgtgtcctccctacctacacaatataccctgtatcattcaaggttctagaactcgaactctaacctacctttccagcctcatctcctatcacatcccctaggaatctcatctctaggatcatttcaacatatccttttcaaaggaagggtttgaactttgggaaatccagttttgagaatgcgttcctcatgc

SEQ ID NO: 82257 - DNA, 601 bp, Human
tcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggagggacacgctccgtmctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggagggacacgctccatc

SEQ ID NO: 82258 - DNA, 601 bp, Human
cctcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggagggacacgctccrtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggagggacacgctcca

SEQ ID NO: 82259 - DNA, 601 bp, Human
ttttctctgccctcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggaggsacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggaggg

SEQ ID NO: 82260 - DNA, 601 bp, Human
gtactgcaataaatcacctcacttaactgatgtgacaacctcgaggaatacagcttcattttttcattttacctctgaggaaaccgaggctaggagaagctgcgtcacttgccccaaatcagacggtgaagtagtgacccaagcgggatttgaagctctgtcccaggctccagtagctccttattaaactcacttccctcactcaacggtgcgctcatctgagcgcacctggggaggacccctgtgtcctgggccctgtcctggggttacccacagggggacacaatgaccggttatccaycctcaaagcttatgcatcagcccagggtgagcactggatcacctgagaacacacaggtgggtcaccaaccctgacctggaaagggtaaggaaatctaaaatgacttcttcccctgaacgccaacagcattttacttctgtctcatcagttattaccttctatctcgttaacagtgactgtgtatttctaatatttttttccttcctgggtgataatttatttgaatgatcagtatcttactcaagtaatccatacattaattcagtctataaatatttattgcatattgtctagtgtgca

SEQ ID NO: 82261 - DNA, 601 bp, Human
atacatctgataaagggttaatatccaaaacagattaggaactcaaacaactcaacagcaggaaaaaaaccccaaataatctgattaaaaaatgggcaaaagaactgaatacacatttctcaaagaagacatacaaatggccaacaggtatatgaaaaaatgtccaccatcgctagtcactggagaaatgcaaatcaaaaccacaatgagatatcacctcactccagttagaatggctattataaacaaaacaaaacaaaacaaaagatgagtgttgctgaggatgtggacaaaagggagccccccccccccgctcttttattgaactattggtgggaatgaaatataaattagtagagccattatagaaaacagtacagaggttcctcaaaaaattaaaaatagaattaccctatgatccagcaatcccactaccgggtatatacccaaaggaaatgaaatcagagtgttcatgacacatgtgcactgccatgttgagtgcagcactattcacaacagccaagacatggaatccacctaagtgtcgccaaaagatgaatggataaagaaacgtggtacctataaacaatggagtactatt

SEQ ID NO: 82262 - DNA, 601 bp, Human
ctggtctccaactcccaacctcaggtaatctgccagcctcggcctcccaaagtgctgggattacagacgtgagccactgcacctggccaaagctttctgacttaagttcttaaactctataatttgagcttccctgtctttaggaagaagacagtaatagcacatttcttataaggttgccaagatgttgagaattcagataaaacctcagcacagtgcccgatagtgcaaaggactcaataaacgtttgctggcattgctggttttaaattactgtataaagtagtagccatccaaaaatataccaaaaaattcatgaaaatggagtacacttacttgtaatgtagtatcaaagacaacaagctttgaactggttggaacgatgtcataacacttgtgtgacctcatgaatcgcatgtaaacaccactttctgagtcttctactgctaaaagaaaaaaaggcaaaacatcagtaataataaagaattccctcaatcggatgaagagcatatacgtaaacctatcactaacagacttaatggtaaaatacgaaatgttttcccagtatgatcaagggccaggcaaggatgctcactctcac

SEQ ID NO: 82263 - DNA, 601 bp, Human
tgctgggtgtcttcccctgccctgctcttcctctgatcccttcatgcttcctcctgggagtgcatccttcataaacccatgaattcttggtttagcatttacttctgaggaactcgactgaggacaatcctacttggaaaatatttatgtagaaacaatacactaaatgtatacgcacagatatgtgtgtagacacccatttgattacactgaatgtagtttgatcacggtattgagtatattatttaggactttttgtatgtgattataagttacattgatataaagtaagttgcaatamgcataattttaataccaaaatgttaagattcaaattttctgggaaaagagatcggtaaggttcttctttcaaaagattgcccatttttgtgattttcttcttttttaccaatattatttcaaatttatcatatgttctactaaataactaagaaagaccatgaggatatactgagcgaggccatacagtttaataatgaacagcttaggttctaacacacattagacaggcctgtgttcaaaaccccatcttgtactagctctgtggattaggtccttaaattccacaacaacttgtgga

SEQ ID NO: 82264 - DNA, 601 bp, Human
ggagtcttgctctgtcatccaggctggagtgcagtggcacaatctcggctcactgcagcctccgcctcctgggttgaagcgaccctcccgcctcagcctcccgagtagctgggactacaggtgacttctaccacactcggctaattttaatttttgtattcttaacagagacggggtttcaccatgttggccagggtggtcttgaactcctaacctcaagtgatctgcccgccttggcctcccaaagcgctggaattacaggtttgagccactgtgcccggcctactgtcgcttatttttwagttggtagaaatgccggtggtcagaaaatctggtattttaaaaagtaaaccttctgggggatgggcgtgaggctgaaataggttgagccagtagttcctttattttgggaattcagaacttctcattattttgttattgaaacatgtagtcacagttctcgagaccgcatctcttaaaacaactgcctactgttttccctactataagattgtatttggatgcttccttctttgtgtcaaataatcaagaatcttagggttttaaaagtgactctgaaggttacctggtccaaagtgaa

SEQ ID NO: 82265 - DNA, 601 bp, Human
ctaatcaatgaatcaatgaatatactcttgacaaacattttctccattatgcagtattctattatatgcctatgcgaggatttatttaactggtctcttaggttgttttgggtacgcggctattttgtttgctttcttagctcttgagggtgtgtcaatggctattactgcagcctgtgtctagaaaatactcaaatcaccccttttcaaatacatctttttaccttgacttaaccaatgccaaacaactctctccccctatttccatggtaatgcatctcagctcctctcaacttagagsctcacaggataaacggcttcccggagatgatgctcacagctcctcttaattacggaagtgatatttactggatcagtcaccttggacatccataaggcattgcatttttcatgtattactcacttgactttctctagggtttagccaaaatgagtaatacatggaaagctgggtaaaagtcaaatcagctgttacttgttattattattttttgagagtcttgctttgttggagtcttgctctgtcatccaggctggagtgcagtggcacaatctcggctcactgcagcctccgcctcct

SEQ ID NO: 82266 - DNA, 601 bp, Human
cactgactgatggagaaaaagctgggcttggtttacaggtgcttctcctgctgggctggcccctgctggcactgcacagtgtggctcttgaggacagtggggattacatcccccagcaggcagacctcccagttggacatttgatttccactttatcaggactgagatggccaggacatatctacatggatccccagggtgattccagtattaaaccgaggggaatctcatggaacccaactgcagggagtccagtcggcctctcaagagaccgaagatggaagcagaaaagccaagcccragactgctcttccccctcattctggtggcacaccctcgcattctgctctcctctcattggctctgttctactcctgtctgcgcacactctttcagcttccctgcaagtggctcgccttggtccctagagcagttacggctctgatgacgtcgtatcctcagagtaacgtggtcattttgagtactgttctgcagcttactttttcttttcctaatcaatgaatcaatgaatatactcttgacaaacattttctccattatgcagtattctattatatgcctatgcgaggatttatttaac

SEQ ID NO: 82267 - DNA, 601 bp, Human
ttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccaaacaagctagccacgagatgcggagaccatgcaacctgagctccccatcacgaacagggaactactaggccccccaagccgaatgctgagcatgcacagcraccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggctggcccctgctggcactgcacagtgtggctcttgaggacagtggggattacatcccccagcaggcagacctcccagttggacatttgatttccactttatc

SEQ ID NO: 82268 - DNA, 601 bp, Human
ggcacgatcaggcatgtggcaagtccaggctgctcttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccaaacaagctagccacgagatgcggagaccatgcaacctgagctccccatcacgaacagggaactacyaggccccccaagccgaatgctgagcatgcacagcgaccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggctggcccctgctggcactgcacagtgtggctcttgaggacagtggggattacatcccccagcaggca

SEQ ID NO: 82269 - DNA, 601 bp, Human
catgtgtacgtgctactctgacaccggtactgagtgacactaaaagctgttttcagagaggcccagggcacgatcaggcatgtggcaagtccaggctgctcttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccraacaagctagccacgagatgcggagaccatgcaacctgagctccccatcacgaacagggaactactaggccccccaagccgaatgctgagcatgcacagcgaccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggc

SEQ ID NO: 82270 - DNA, 601 bp, Human
gaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggctgcrgcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacaccccagaacggcctgaaacactggagacacccctccaatgggagcttcaagttgtcactccacactccacctgccactgcaaccaccaggcaggtgttttg

SEQ ID NO: 82271 - DNA, 601 bp, Human
gaggaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggckgcggcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacaccccagaacggcctgaaacactggagacacccctccaatgggagcttcaagttgtcactccacactccacctgccactgcaaccaccaggcaggtgtt

SEQ ID NO: 82272 - DNA, 601 bp, Human
gctcacttggttgactgcctgaagtgcagggcactgctgagtccgtgtttaatgaggctgagatgccaggcttctgtggcacagtgaactatacaggaggaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggccacatactccttttctctataccaatctacaaggacccctagacggagtctgctttacctggcaacaggatactttcacccgtgtgtctcaaggctgcggcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacacc

SEQ ID NO: 82273 - DNA, 601 bp, Human
aaaacaaactgtgagatcttgccatttcacagctgcagaaaccgaagaagtatgtatgggaataggtgctagtaacgttaggacaaagacgagaaatttaacactagtttggtgggactgattgctatgagtggtcttatgagaaattgttcattaacattttgtgcacgcagccggcagtggctctaaccgctcacttggttgactgcctgaagtgcagggcactgctgagtccgtgtttaatgaggctgagatgccaggcttctgtggcacagtgaactatacaggaggaatccacagscttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggctgcggcacccccgc

SEQ ID NO: 82274 - DNA, 601 bp, Human
gaggcagaggttgcagtgagccaagatcgtaccactgcacttcagcctgggtgacagaatgagaccctgtctttaaaaaaaagaagaagaagaagaaaaaagaaactgccaagactggttcccaggaacagaggacttggaattggtttcccatccatgggtttaacacagtgttgagctctttgtcagtgggaaatcagattcctgtaatccagggcaggccatggcattgtgactaaaaaagccatcatctgtgcctgtgatgacatttgtgtgccagggcccacatggccactgcacyggccactgaggcagaagccaggaccaaaggactcagtatgacagcattctgtgagtgcgctggggcctctgagaaaacctcaagcccaggtctgggacctgcacccacagacagagaacccaacaagcctctatggcagtccccagagagtctatttcttgtagctacagggctgtttccaaaatcaaacacaaagcataactctgcggggtgtggatgcacaggcggaattggtggcatcaccaggtttgatgggaaagctgggcatggatctggaaggagtgggaccctggcaccgga

SEQ ID NO: 82275 - DNA, 601 bp, Human
gaattgcttgaacctgggaggcagaggttgcagtgagccaagatcgtaccactgcacttcagcctgggtgacagaatgagaccctgtctttaaaaaaaagaagaagaagaagaaaaaagaaactgccaagactggttcccaggaacagaggacttggaattggtttcccatccatgggtttaacacagtgttgagctctttgtcagtgggaaatcagattcctgtaatccagggcaggccatggcattgtgactaaaaaagccatcatctgtgcctgtgatgacatttgtgtgccagggcycacatggccactgcactggccactgaggcagaagccaggaccaaaggactcagtatgacagcattctgtgagtgcgctggggcctctgagaaaacctcaagcccaggtctgggacctgcacccacagacagagaacccaacaagcctctatggcagtccccagagagtctatttcttgtagctacagggctgtttccaaaatcaaacacaaagcataactctgcggggtgtggatgcacaggcggaattggtggcatcaccaggtttgatgggaaagctgggcatggatctggaaggagt

SEQ ID NO: 82276 - DNA, 601 bp, Human
tcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtctttattggcagcatgaaaacaggctaatacactaactgatacctatctttctctgaattcctgggcttatctggaagggaaggggatgtcccccctctctactgtgccagtcatgaagttactgtctctctgctccatgcccayccctctaacttggcttggtgatgctgggactttgcagaccctgtttcggtgttgccaactggctctatttcaggttctgacaatacaggagtctagggagggactcaaagccagagcaggaagaagggcttgctcctcccgtcagcggctagcagggctcctgtctgcctgcagctcccgtgagctccacccaggcactgccttacctgggcaccgaggcacctcctgtagcagcggctgaatacagtttgttgttttcccattttgtgcaaaatgagcttcctcaagccccaactccca

SEQ ID NO: 82277 - DNA, 601 bp, Human
agctcccataattcccacgtgtcatgggagggacccagtgggaggtaactgaatcatgggggggagtctttcccatgctgttctcatgatagtgaataagtctcacaagatctgattttttttttttttaagacagattcttgctctgtcgcccaggctggtgtgcaagtggtgcaatcttggctcactgtaacctctgccttctgtgttcaagcgattctcctgcttcagcctcccaaatagctgggaccacaggtacccaacaccaagcccagctaattttcgtaattttagtagagayggtttcgccatgttggccaggctggtctcaaaatccaggcctcaagtgatccacctgcctcggcctcccaaagtgctgggattacaggcgtgagacaccgcacccagcgatctgatggttttataaagaggagttcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtctttattggc

SEQ ID NO: 82278 - DNA, 601 bp, Human
aattgaagctcccataattcccacgtgtcatgggagggacccagtgggaggtaactgaatcatgggggggagtctttcccatgctgttctcatgatagtgaataagtctcacaagatctgattttttttttttttaagacagattcttgctctgtcgcccaggctggtgtgcaagtggtgcaatcttggctcactgtaacctctgccttctgtgttcaagcgattctcctgcttcagcctcccaaatagctgggaccacaggtacccaacaccaagcccagctaattttcgtaattttagkagagatggtttcgccatgttggccaggctggtctcaaaatccaggcctcaagtgatccacctgcctcggcctcccaaagtgctgggattacaggcgtgagacaccgcacccagcgatctgatggttttataaagaggagttcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtcttt

SEQ ID NO: 82279 - DNA, 601 bp, Human
cttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttactttacttttgatcatgtgctctgcattcggtattctctactcattcttcaaggtgggtggatcacttgaggtcaggagttcgagaccagmctggccaacacggtgaaaccaagcctttactaaaaatacaaaagttagctaggcgtgttgttgcccgcctgtaatcctagcttctcgggaggctgaggtgggagaatcgcttcaagtgagccgagattgcgccactgaactccagcctgggcgacagagcgagactctgcctcaaaagaaaaaatagtgcttggcaaacagccacttatttggatacttgcttgtttttttgttggcattattcaaaatcacattgcctggaataatgtaaagaacaaaatgaagttgttctggattata

SEQ ID NO: 82280 - DNA, 601 bp, Human
gtgggctttagtttcctcgaatcactattactttacctcttccactttgaagatcattttccttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttactttacttttgatcatgtgctctgcattckgtattctctactcattcttcaaggtgggtggatcacttgaggtcaggagttcgagaccagcctggccaacacggtgaaaccaagcctttactaaaaatacaaaagttagctaggcgtgttgttgcccgcctgtaatcctagcttctcgggaggctgaggtgggagaatcgcttcaagtgagccgagattgcgccactgaactccagcctgggcgacagagcgagactctgcctcaaaagaaaaaatagtgcttggcaaacagccacttatttggatacttgcttgtttttttgttggcat

SEQ ID NO: 82281 - DNA, 601 bp, Human
tggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgattcatctggatcagaaatgagatgtggttcrtgctgacaggtgctctccgcaactattgtgggctttagtttcctcgaatcactattactttacctcttccactttgaagatcattttccttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttact

SEQ ID NO: 82282 - DNA, 601 bp, Human
gagggccgtcccactgcccctgcacagagtgaggagtgctggactatgagttgatgtgaatggatttggaaatggcccacgagaggcatccaacacaattagaaaccttgctccaggtgttgactgagatttaaatattaattgatctgcttggctgccaagctgcagctctgcatctcatcctctgggacctcgtgccaggctctgccagcctagtctagctggaatccagacgtgcctgtcatggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgattcatctggatcagaaatgagatgtggttcgtgctgacaggtgctctccgcaactattgtgggctttagtttcctcgaatcactatt

SEQ ID NO: 82283 - DNA, 601 bp, Human
gggatcttcctaggactgcatgtagctgctagcttctatcctcccctggcggaggaagctggggtacatgggatggtcctgggctgagggccgtcccactgcccctgcacagagtgaggagtgctggactatgagttgatgtgaatggatttggaaatggcccacgagaggcatccaacacaattagaaaccttgctccaggtgttgactgagatttaaatattaattgatctgcttggctgccaagctgcagctctgcatctcatcctctgggacctcgtgccaggctctgccagcctastctagctggaatccagacgtgcctgtcatggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgatt

SEQ ID NO: 82284 - DNA, 601 bp, Human
ggacttggtaaaattattattaaaagatggaaagtagtaagtcaaagatgctatgtaatctgtaagacagcctctgaaagatcaacaaaagaatgtataactaagttcacatgttctcatccatttgtgggagctaaaaatgaaaacaactgaactcatggaaatagagagtagaatgatggttaccagaggctgggaagggagggtagtgggggtgggtgcggggaggaagtaggggcagttcatggataaaaaaatgtagttagatagaatgaatacggtctagtatttgatggcacarcagggtgactacagtcaacaataatttattgtacatttaaaaataaccaataattgggatgtatgtaatgtaaagaaatcataaatgcttgaggttatggacaccccatttatcctgatgtgattatacaatgtatgcctgtatcaaaatatttcatgcaccctataagtatatacacatactatgtacccataaaaatgaaaaaagaatgtataactaaaaagctagcagaggagaaaaatgggttaaacatagtttgttaaatcgagtgaagaaggaataaaagaacaaatcaataga

SEQ ID NO: 82285 - DNA, 601 bp, Human
atatagaagcaaaatatataacaatagcacatagggtaggagacggtttaacttttgtatacattttttgcattgtttgggacttggtaaaattattattaaaagatggaaagtagtaagtcaaagatgctatgtaatctgtaagacagcctctgaaagatcaacaaaagaatgtataactaagttcacatgttctcatccatttgtgggagctaaaaatgaaaacaactgaactcatggaaatagagagtagaatgatggttaccagaggctgggaagggagggtagtgggggtgggtgsggggaggaagtaggggcagttcatggataaaaaaatgtagttagatagaatgaatacggtctagtatttgatggcacagcagggtgactacagtcaacaataatttattgtacatttaaaaataaccaataattgggatgtatgtaatgtaaagaaatcataaatgcttgaggttatggacaccccatttatcctgatgtgattatacaatgtatgcctgtatcaaaatatttcatgcaccctataagtatatacacatactatgtacccataaaaatgaaaaaagaatgtataactaaa

SEQ ID NO: 82286 - DNA, 601 bp, Human
taaaatactttaggctttctgctttcaaggtttccattttcgattttcctcaggcccacactgcttacctacaaaactttgttttttactctcccacagtggcgctgctcggacaccgttggctaccaaagcaaagaaggcctttttaacctgaagaaaaagaggagaaacaaaacatactttcaaagtccaggaagaaaaataccttttttttttgagacaaggtttcactctgttgcccaggctggagtgcagtggcaccatcttggctcacagcaacctctgcttcctgggctcaatygattctctcacctcagcctcccgagtagctgggatgacaggcatgtgccaccatgcccggctaatttttgtatttttggtagaaacagggtttcaccatgttggctaagctcgtctcgaactcctgacctcaagtgatccatccacctcggcctcccaaagtgttgggattacaggcgtgagccaccgcacctggccagaaaaatacccttaacatatttgaccaagtcttatcagttatcttccataataagtttcgtaagtttgataagctaaaaataatggaatttattaacattag

SEQ ID NO: 82287 - DNA, 601 bp, Human
gatgccatatgccatgtgtggcccaaagtggggcagctggctcacatctgactgtggtgtcctacgtggggtttgttcattgggctggtaaagacacataagctcttcagagagccaaaaagttgctaaattaaaagaaattcaacaacaacaacaacaacaaaagctccataaaagttacaacagtgtgtagagttctcaatgaggcggcaaaaaaaaaaaaaaaaagaaaaaaaggacaacagtgtttggaccttactagcacgtccaccttcttacccagtatgtaaaagcaaggaattttttttttttttttgacagggtctcgctctgtcacccaggctggagtacagtgcagcgatcatggccttgacctcctgggctcaagtgatcctcccacctcagcctcctgagtagctaatttttgcatgtttttgtagagatgaggtcttgctatgttgcccaggctggcctcgaactgctgggctcaagcgatctccctgccttggcctcccaaagtgctgagattacgggcatgggccactgcaccctgccagcaagaatgttctttaacttggaaacatgtttactaggttgaatt

SEQ ID NO: 82288 - DNA, 601 bp, Human
actacccctgccttaaagcacttccagtgtttttattattgcaataataacagtgttttggaagagttttaaattagagatctcagcaaatttttcatttttcacaatctatgttaacatatctcaaatacaagtgcaagctacaaatctctagaagaggagattttttttggtttgtttttttgagacagggtcttgctctgttgcctgccgtcatggctcactgcagccttgacctcccgggctcaggtgatcctcccacctcagcctatttgagtagctgggactacaggcatgcgcyacctttcttttttgtagacatggggttttgccacgttgcccaggctgctctcgaactcctgagcttaagcgatccacccaccatggcctcccatagtgctgggattacgggcatgagcccttgcgcccagccaggaagaggagtttttttaaagagtgtatttagtgattttatttgaaagacgatgaaacctaaatccttagaaaagcaaacagatacatcgtattggcaagagagcaaaggctgtagcagcaagctctctgcattggtgagtgggcaaactggctctaccccgggccg

SEQ ID NO: 82289 - DNA, 601 bp, Human
tggtctccagtatttccagcttattgcacttcacaacaccttcaaaatactgtgaacggtgctgaagggcctgggtcaccgtgatatctaggttattgtatgttttctcagcagcaagattctgtaatgaagcaagagaataaattatatcctttcatttcagttcacttcaatgaccaaaattagtgagcttaagagagcctgatttctaaaaactttaatgcttatctgaatttagtacctgcatacatcagacgttctttctggcttacgacatgccattgctactgttattttgtcwacatatcaatcacaattaaagataaccatgttacaaggtctaccttccttacgaagcaacattgttaaactttgacagtatatcctgccaaagactgccccccaatttttaccctctaatgctctctaccatgcatggatgaaatctctggcaaggtgggctgacatctgtaaagggtggtgagtgccacagggctagaaatgctgcagcaacggaccttctcaacaagctccctggggaacaaggtttctgctgggaaggctttgggggacccatggggatcaagcaaccagaggaaga

SEQ ID NO: 82290 - DNA, 601 bp, Human
taatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacagagcaagactccgtctcaaaaaaaaaaaaaaaaaatagtggatattaaacagatatcttttgaactctgaaggytaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtccttctgtgaggagtcatcttgtgaaggaattttctttttaggcggagtcttttatttagggtgttacacaaag

SEQ ID NO: 82291 - DNA, 601 bp, Human
attttattggttacattcaatagtggatattagccgggtgcggtggctcatgcctgtaatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacagagcaagactccgtctcaaaaaaaaaaaaaaaaaatagtggatattaaacagatatcttttgaactctgaaggctaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtccttctgtgaggagtcat

SEQ ID NO: 82292 - DNA, 601 bp, Human
tcttctacactgaagacattttattggttacattcaatagtggatattagccgggtgcggtggctcatgcctgtaatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacasagcaagactccgtctcaaaaaaaaaaaaaaaaaatagtggatattaaacagatatcttttgaactctgaaggctaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtc

SEQ ID NO: 82293 - DNA, 601 bp, Human
cgcttgacttgtttactctttttgtaatgcccaaagagacagacaagagctgacattcagcctgacccgctgggcagactgtgtcccgtggtccagggctggaaacggggcatctttttctgaaggtgccaagctatatacctgtggggataaatctgcccagagaagaggccttttctagttagcacaaatgtgctgtgcagttatgcctgcctggaaatttatatgaatttaatgatggtctggatgagcctggctccctctgttcaatgttgcctgtgagattcctccactgttgaaygcagctgtactgttcgttttcaatcctgtatcgtattccatcgaatgaatgtgacacaatttatccattcttcttttcaaagatatttggattattcccagttttatggcattaacattcgtttagttcttaatgtttcatgattatagagactattgtgagattcaggtcttttaaacacttgaagtttgcaagtgactgcaccaggccccatttctagagtttctgattcagtggatatgggacggggccccaacatgaacatttcattttctagtaaattccaggtggtggtgatga

SEQ ID NO: 82294 - DNA, 601 bp, Human
tttcacacgcgtgcgccccggctgcggcggtgacatattgctgtattcggacataaggcactgtgatctgaacataccgtgcactcaccttatgccacatcacctgttccataccagtgaattctttgaaatgaaaaataatgaaaacttcaggacacagtgcactttaatgacatacagcatttaaaatccttcagacaaaggtctgaaaacagtcttttaatgcaagcctgaatcttcaagcacataaaatctttcttttttaagcttaatttcaacatcactggaagaaatacctatygttaaaccctgatatacattcttaaccacttgcagccagtgttcatgaggcaaaacgtgacccagagactttgttcaagttctcctcctagggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaggaggatgatccagaggcttcggaggagggcgacgtgggaaggagcaggtagcccaagctccca

SEQ ID NO: 82295 - DNA, 601 bp, Human
caaagggcggttcctttgagccctttgggaggaccgcccgacctcggcccctggaagttccgaactgtcggaagagctctcagcctctgggtttgaggcggcccgggggtccagccagcccaccctcgctccgccggtgctcgctctatttgaaaacgctgactgttggtcccccaagcagcagtctggagtcagcccagcccgtctgcagcggtggagccagggctaagccttctccggtcataatgagagaacccgggcaccgccccccgggaccaagccttccgcgaaatctgcttakagcccccgagggatggagccggggaggggattggtgtctgggaaactagtcctgagaaacacggacatcacccggcatcttagctggaaacatcgagtcagaccccttcgcttcacagaaggggaaactgaggaccaaagaaggcggccgtcgggttggcgtggaaagagagccctggtttccagtgccaccgcggacctcaacccgtggcgtggccttgggcaagtcctttcccttttgtgggcctcggtttccccatctgtgaaatgggtgcgtttgacttggccttcagtagggctc

SEQ ID NO: 82296 - DNA, 601 bp, Human
gtcattaaaatcatgttttacagagaatttgatgatgtggaaaacgctcatggtgtgaagtgaaaaacgcaagacacgaaactgtacttatgggtatggttccaattttatcaatatatatccataggaacacacaaagaatgtggaggggaaaaaaaacaaaatatcaacagcaactgtggatttgggggttgcagatcattttcttttacacttttcgttatttcccagatattctacagcaagtgttctccaaggactcaaaactcagagaaggcgcctgtgctaggagcagtaactwgctttccttgtctttcttcatgcttttctcctgcactaagcactgacacaggcctggtgctaccctagaacctcctctgtgcctcagtttccccttcggaacaacagctcaaagggcggttcctttgagccctttgggaggaccgcccgacctcggcccctggaagttccgaactgtcggaagagctctcagcctctgggtttgaggcggcccgggggtccagccagcccaccctcgctccgccggtgctcgctctatttgaaaacgctgactgttggtcccccaagcagcagtctggag

SEQ ID NO: 82297 - DNA, 601 bp, Human
aacttttgaaaactttgtatagagtcattaaaatcatgttttacagagaatttgatgatgtggaaaacgctcatggtgtgaagtgaaaaacgcaagacacgaaactgtacttatgggtatggttccaattttatcaatatatatccataggaacacacaaagaatgtggaggggaaaaaaaacaaaatatcaacagcaactgtggatttgggggttgcagatcattttcttttacacttttcgttatttcccagatattctacagcaagtgttctccaaggactcaaaactcagagaaggygcctgtgctaggagcagtaactagctttccttgtctttcttcatgcttttctcctgcactaagcactgacacaggcctggtgctaccctagaacctcctctgtgcctcagtttccccttcggaacaacagctcaaagggcggttcctttgagccctttgggaggaccgcccgacctcggcccctggaagttccgaactgtcggaagagctctcagcctctgggtttgaggcggcccgggggtccagccagcccaccctcgctccgccggtgctcgctctatttgaaaacgctgactgttg

SEQ ID NO: 82298 - DNA, 601 bp, Human
aacattctttctccaatgcttgtatcacccctttctaatgctccctgaatcagctttactctcctgtttgctacctcattaatgagttgaataaatcttggccacatttgtatgagtcgtgtttttaacttttgaaaactttgtatagagtcattaaaatcatgttttacagagaatttgatgatgtggaaaacgctcatggtgtgaagtgaaaaacgcaagacacgaaactgtacttatgggtatggttccaattttatcaatatatatccataggaacacacaaagaatgtggaggggraaaaaaacaaaatatcaacagcaactgtggatttgggggttgcagatcattttcttttacacttttcgttatttcccagatattctacagcaagtgttctccaaggactcaaaactcagagaaggcgcctgtgctaggagcagtaactagctttccttgtctttcttcatgcttttctcctgcactaagcactgacacaggcctggtgctaccctagaacctcctctgtgcctcagtttccccttcggaacaacagctcaaagggcggttcctttgagccctttgggaggaccgcccgac

SEQ ID NO: 82299 - DNA, 601 bp, Human
ggattctgggcatattctggaggtcaagcccatgaatactgctcccatggagctttagttttcttgcctgtaaaatgaagacaaagatgctacctgcccatctcacagctttattgtgaagagtcaatatgaaattgcctcctactccgcagagcatcactgcatcaagttacattaattggagcttcctaatggcaagtttacatttgtattccactttctacttcccaaatcactctcccaaaccagttctccttcatgctcaaggcaaccctgggaagtaggaagtaggagtcctgtkttttttttcttttgagacggagtctcgctttgtcgcccaggctggagtgcagtggtgtgatctcggctcactgcaagctccgccttccgggttcatgccattctcctgcctcagcctcccgagtagctgggactacaggcacccgccaccacacccggctaatttttttgtatttttactagagactgggaggagtcctgttttgcaagaaagagaatttaaactataggagagatttgttcagggcgctgcagaactcaaatactggcggcagactatcttaacaaaatggtaatttcc

SEQ ID NO: 82300 - DNA, 601 bp, Human
gctgcgtcttattaaaatagtttatagtttatattattatcttttttctctccaagtacattattccttcaagaaaatgaagtatgtattatgcagagcaaaaataacaatgacaatatttaatgaattccaatcaagactaagtgatttctgtgacaccaacacatctgcacttagcttgtgtcagcattaatgtgaattttcatttcctcaactaatagcattgggaagtgttctagaagtttgtcatacaaggaaggaaagtcccatctgtgatctccaaaatgggcacccagaggayagagtgggccagaaacagaactaatggtgatgactgggattctaagaaagttgagtaggtagcccaaacctcagttgtcaactcctgccagtgtaaatgaggtcttttgagtcttaccttttctctcacggggctttctgaagtcttccactgaggtatgataagttcatgctgcagcttggggctgccttcctcacttcctcctgccaatacaagatgcaaaaccattggaatcccagacctctataccccagctaagccacacatgcactttctgtgagctgcccctgcactgggtca

SEQ ID NO: 82301 - DNA, 601 bp, Human
gtaatcccaacactttgagaggactacgtgggcggatcacttgaggtcaggagttcgagaccaccctggacaacatggtgaaaacccatctctactaaaaatacaaaaattagcctggcttcgcagcacacacatgtaatctcagctactccggaagctaaggcatgagaatcgcttgaacctgccaggcggagctcacagtgagccgagatcatgtcactgcactccagcctgtgcgacagagtgagactctgtcaaaacaaacaaacaaacaaaaaaacaaaaacaaaaaaacaaaaacaaaaaccagaaccacaaagaatatcctaaatgctcaggtcctctctgcaagaacaggacagtgttttttgttttcttcccaatctctttgataaagcctatgtgttttcctggtgttctggccaggggagcctactggattttaagatacattccccagtactaggtctctacgctgcgtcttattaaaatagtttatagtttatattattatcttttttctctccaagtacattattccttcaagaaaatgaagtatgtattatgcagagcaaaaataacaatgacaatatttaatgaa

SEQ ID NO: 82302 - DNA, 601 bp, Human
tactttttgatgaaatgaattccatgcgtttactgcctttaggacaaaatgttacttgcttttatttgtcctgatttttttttttttttttttttgagacaaggtcttgcattgtcactcagactggaggacagtgatgctgatgcgactatatcttactataacctcaaactcctgggctcaggcgatcgtcccacctcagccttcagagtagctgggactacagacacacacccctaggtctagctaattttcttttttttttttttttttttttgtagagataggatctcagtatggkgccccaggctggtcttaaattcctggcctcaaatgatcctcctgcctcagcctcccaaagtgctgggattacaggcttgagccatcgcacttggtctgtcctaaaatttacactgttaggttcccttggtaaatccaagttggagcctttttggacatgtctgtattatcctggccagagtttcaaggatcctggacattgctcctttccatttatctttccagattcaacagccacaatgtctgaagtctttcctgacacatctctttcctgctataatcttgctcctatatgttgccc

SEQ ID NO: 82303 - DNA, 601 bp, Human
ctgctctaggatgaccatccattaatttgtcgagacttttcctgaagctattttcagcctctcctactttttgatgaaatgaattccatgcgtttactgcctttaggacaaaatgttacttgcttttatttgtcctgatttttttttttttttttttttgagacaaggtcttgcattgtcactcagactggaggacagtgatgctgatgcgactatatcttactataacctcaaactcctgggctcaggcgatcgtcccacctcagccttcagagtagctgggactacagacacacacccctaggtctagctaattttcttttttttttttttttttttttgtagagataggatctcagtatggtgccccaggctggtcttaaattcctggcctcaaatgatcctcctgcctcagcctcccaaagtgctgggattacaggcttgagccatcgcacttggtctgtcctaaaatttacactgttaggttcccttggtaaatccaagttggagcctttttggacatgtctgtattatcctggccagagtttcaaggatcctggacattgctcctttccatttatctttccagattcaacagcca

SEQ ID NO: 82304 - DNA, 601 bp, Human
aatctgctctaggatgaccatccattaatttgtcgagacttttcctgaagctattttcagcctctcctactttttgatgaaatgaattccatgcgtttactgcctttaggacaaaatgttacttgcttttatttgtcctgatttttttttttttttttttttgagacaaggtcttgcattgtcactcagactggaggacagtgatgctgatgcgactatatcttactataacctcaaactcctgggctcaggcgatcgtcccacctcagccttcagagtagctgggactacagacacacaaccctaggtctagctaattttcttttttttttttttttttttttgtagagataggatctcagtatggtgccccaggctggtcttaaattcctggcctcaaatgatcctcctgcctcagcctcccaaagtgctgggattacaggcttgagccatcgcacttggtctgtcctaaaatttacactgttaggttcccttggtaaatccaagttggagcctttttggacatgtctgtattatcctggccagagtttcaaggatcctggacattgctcctttccatttatctttccagattcaacag

SEQ ID NO: 82305 - DNA, 601 bp, Human
ctcactgcagcctcaacctcccaggctcaagcatactgagtagctgggaccacaggtgcatgccaccacactgggctagtatttttaaattttttgtagatactggggtattaccatgtttccaaagctgatcttgaactcctgggctcatgtgatcctcccaactcagcctcccaaagtgttggtattacaaatgtgagccacctcatccagcagataaattcttgaagtccctttcaatccacaaaatcattgctagagtagagcttctagcccttctaaggttgacctcaaagcttasttcttgcatgtctgagaaagtaggtcacctgttctgccacctctggttagaagcctacctcgtctaagcacattccccttcctcgctgcaaaccccactctgcattaggatttgggcatttctgagactttgaggtcaccaagggctctgatgagatctcaacattccgatcaaaggctcttgggcaacgctggccattgcctaattaatcgtattacttcatctcaagaaggaacatttcaaacccaccgaagtaggaagctggggagatgtttgaccaataactttcactaagagatt

SEQ ID NO: 82306 - DNA, 601 bp, Human
ttaaggctactgaacttttttcgaagaaataaattatttttttaaaaaaggatatttacatatttaaaacagaacagattctttggagtgttttaaacataagctctctattttgggactaaggaactgacaactttttttgagacggggtcttgctttgttgtgcaggctggagtgcagtggcacaatcacggctcactgcagcctcaacctcccaggctcaagcatactgagtagctgggaccacaggtgcatgccaccacactgggctagtatttttaaattttttgtagatactggsgtattaccatgtttccaaagctgatcttgaactcctgggctcatgtgatcctcccaactcagcctcccaaagtgttggtattacaaatgtgagccacctcatccagcagataaattcttgaagtccctttcaatccacaaaatcattgctagagtagagcttctagcccttctaaggttgacctcaaagcttacttcttgcatgtctgagaaagtaggtcacctgttctgccacctctggttagaagcctacctcgtctaagcacattccccttcctcgctgcaaaccccactctgcatt

SEQ ID NO: 82307 - DNA, 601 bp, Human
tgggccaggcgcagtggctcatgcctgtaatcccagcactttgggaggccgagacgggtggaccacttgaggtcaggagttcaaaaccagcctgaccaacatggtgaaaccccgtctctactaaaaatataaaaattagctgggcgtggtggtgcacacctatagttctagctattcaggaggctgaggcaggagaatcgcttgaacctgggaggcggaggttgcagtgagccgagagcatgccactgcactccagcctgagcgacagagcgagactctgtctcaaaaaaaaaaaaaaaaagtaatgaataatgaaatgtaacctaactgtcctaaatataacctgttagagaatggttaaataaatgatgatccattcatatgacagaacactgaatgatcattaaaagcagcaactttaagtagttgttaaattactgacaaaatgtacacaataatcattagtcataaagctcaaaatacaatactgaatattttatttaaatacacttcgcaaagggaaaaatgtagagagaaataagcctaaccattaccatagttaatgggatcatgagttaattttgttttcttttgcacatct

SEQ ID NO: 82308 - DNA, 601 bp, Human
cgtctctaccaaaaatacaaaaattagccaggcatggtggtgggcacctgtgatcctagctactcgggaggctgaggcaggagaattgcttgaacctgggaggcgaaggttgcagtgagctgagattgcgccactgcactccagcctgggtgacagagcgagacactctctctcaaaaaaaaaaaaaaatgtttagactcaggaatgtgaggctgtttgaaaggaataaatggaggcacaggcaaaggtttgcacataaggacatttattacttataataatgaataatgggccaggcgcrgtggctcatgcctgtaatcccagcactttgggaggccgagacgggtggaccacttgaggtcaggagttcaaaaccagcctgaccaacatggtgaaaccccgtctctactaaaaatataaaaattagctgggcgtggtggtgcacacctatagttctagctattcaggaggctgaggcaggagaatcgcttgaacctgggaggcggaggttgcagtgagccgagagcatgccactgcactccagcctgagcgacagagcgagactctgtctcaaaaaaaaaaaaaaaaagtaatgaataat

SEQ ID NO: 82309 - DNA, 601 bp, Human
agcataaataatgtatcacagtgcctggcacacggcaagccatgatacatattgcctattatcttgtaaaatactaggggatcctcttcgtagtgggttcttatttcattttggctctccgtttggaaaaccccaatcatctcagaggaagcaactaagagatcctcaaattaaggttttataggccaaaaagtagatacattttacacataagcagtttggtagtggccacaggtgctacatatccagaacggatcacttaacatataccagtggttgataagcacaaaaactatgttcracatcgctaataaaccacctccccacgtccagaaaaacaaattaaaaataataagataccttgaaaaaaatcaaagtgccagaggttatctaaaactctaaatcacaatgcacaatgcccactgtaaactgggcactcgcaatccctaccactgagaatttaaactgacggcaactctctgaaagataacatgacagtatgcactgagagtttaaaaatgtttagactcggccgggcacagtggctcacgcctgtaatcccagcactttgggaggccgaggcaggcagatcaggagtttg

SEQ ID NO: 82310 - DNA, 601 bp, Human
ccattaccctgagctcagctttgagtggatgctaaaagcaacaacaaaacaatgtcagttcctaaaagccggcaccaggctccctgggtcgggcacaggatctagcacagcgctccaacattgatccacaggaagtgaatgagcaaaggtcaattgcatttccagcccacatgtaaaatgacctcaatcccagaatgacccaaatccttcccccatctgctttctcctgaaaggcatagagaagaaactccaggctgcaatgtggtgtaagtgtatgtatgtggtgcggtgaagggaaacrctggaaaacacaatctccagcagtaaatgtcctgcagagtcagatctggattcaagcaccggctctgacacctgcagctgtgtgaagtcggacatgttgctgagcctccccacatctcagtttcttcatgtatgatacagagatagtaatagtcaatttgatggggatcttgtaaggattgagtgagataatgagcataaataatgtatcacagtgcctggcacacggcaagccatgatacatattgcctattatcttgtaaaatactaggggatcctcttcgtagtgggttcttatttc

SEQ ID NO: 82311 - DNA, 601 bp, Human
gtcaagaggctgtggaaaggctctggctttgcaagatgctgcctgaaagaaaccaaggactgagagcttggggtcactccattgactgcttccttccagaacagcgacacctgcgtccggcgttgacacagaagttatttgtttcattttagacaaaggaggagtccacttactcattcttctccaggtccaggatcagttctcgcccctcagccattaccctgagctcagctttgagtggatgctaaaagcaacaacaaaacaatgtcagttcctaaaagccggcaccaggctccctggrtcgggcacaggatctagcacagcgctccaacattgatccacaggaagtgaatgagcaaaggtcaattgcatttccagcccacatgtaaaatgacctcaatcccagaatgacccaaatccttcccccatctgctttctcctgaaaggcatagagaagaaactccaggctgcaatgtggtgtaagtgtatgtatgtggtgcggtgaagggaaacactggaaaacacaatctccagcagtaaatgtcctgcagagtcagatctggattcaagcaccggctctgacacctgcagctgtgtgaag

SEQ ID NO: 82312 - DNA, 601 bp, Human
tgtttcaaaataggagggaaggatagagacttgagtcctgggactcctgcttggccagtccaactcctaagcattttcccacaacaccaacactatcacttgggctgaccagagggagctgaagggccacaggctctactgggggcagaacaggagagattagacacaggcaacaacagggaacacttagactagagttaatgggaacaaagctgccgtgagcaacaaaggcaggcccccgagagacacggtcaagaacaaaccctctaagggccttttcttgtaggaccaaaggaagacmatgcaaggaaaaatccagggccaatagacgctgcactgtctagggacgcagctggccaggtctattccagggacacaggagagaagaaacacagcctaaactggctttactctcaagaggagaggaacaaaaatgactgtgatccccatctttctggcttcccgaggccaccatgtcctggaggcagaggaaggatgtggatgaagccccaccactgcacaagctgtgagttgtattttaaccacactcgggacagcactcatcctcctttgcaagtgcccaaaaagcccaaatttggaa

SEQ ID NO: 82313 - DNA, 601 bp, Human
gtggctggccactcaccatgcgctgtgcaagcacttcctgcacttcacctcatttatcctcacaaccatcccacgaggctggccttattaccctcattttataaacaaggacaccgaagttccaaaagattcagccatttgccctgggtcacattctgtaactccagactcacaccaagaatacacatgatcctagtttcagctctttcatttacttgctgggtggcctcagacaaatgcctatccctctctgaatcaaaacttctgcatccataatttcagagttttctaagatcattcyattcagtgttttctaaggcatcttcctgctttagcttcctatggtctgtagcaaatgtttcaaaataggagggaaggatagagacttgagtcctgggactcctgcttggccagtccaactcctaagcattttcccacaacaccaacactatcacttgggctgaccagagggagctgaagggccacaggctctactgggggcagaacaggagagattagacacaggcaacaacagggaacacttagactagagttaatgggaacaaagctgccgtgagcaacaaaggcaggcccccgagag

SEQ ID NO: 82314 - DNA, 601 bp, Human
atgctttgcttttgcaatttaaaaacaatgagcaagaaataatcatagctaccttgagcttggaatacaaacaaggcactctgctaagtccttcacctgtaccatctcatttcatcctccctgtggctctggctctatgacatgggactataattacaccccagatgcacaaactgaggcttaaagaggctacaaggtagtaagtggcagagccaggatctgaacacaggaataaccgacacaaaagcaatgctcagattatccctaaagggtcactgtttttcacctgcactcaatagaraaaagaatgtgtgcttctcacggatgtcatccgtgagttgctgagttgcttcaaagcagagacaggctgccggctgccgcgctattgtaggacacctcagtgtgtctgctgcctgagctgaagctcactttgctgtgttccccctcctctcctggcccatgccccatgcctttccatcctcaccattcttggcgatctctccatgtgtgaattccattaaaggcttgctcactgctattttgggccatgcattaatacgtgggctttgatttgatgggagaaggccagacacggcaggat

SEQ ID NO: 82315 - DNA, 601 bp, Human
caggatgtctccacaggtagagcaaatttcctgaggcagagacttcttttgcatttttctactcacagagcatcctttaaagaggtagtgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggraggcggagcttgcagtgagccgagatcccgccactgcactccagcctgggcgacagagcgagactccgtctcaaaaaaaaaaaaaaaaaaaaaaaaaaaagaggtagtgcagaaagagccttcagagcctatccggggccaaaatctgcattttacagatgagaaagcagaggctcaggggagctggctggctttttgaccaatttcatatcatctgtctctgaggtcaatgctatgtccactgtaccacactgcctcaatcacaagtttctccaacagcagctatgcaccaatctttgc

SEQ ID NO: 82316 - DNA, 601 bp, Human
tctctccctttctcaagccatcatcatttggacttgaggaaggacagtgtattgaagaaatgagagtcctagaatgtgtttaagatactagaagacagaagcatatggccaaagagcctctgggcaaagtgcctactagttgagccattcatttgcttttgaaggtgatcttgtaatagagtgatcctgctcactagtaatgcggcccagtgagcatccaggaatctggttgagcaattcagtgtgccctccttttgggaaaaagccaagaaaggacaggatatggcgctggggctcacayaaccctgttcatctccctggatgcctgcagctaactaaggaggattccatttgatttcagcaaacaagtttttgtcaaatatgggttcctgggttggtgaggtagtctcaggacatggggaaaagaacatagagaaaaaatatggattaatgctcaaatctgtgggttgtgcaaacagcagtctataatttctgctctgtagtttcccttcttgtattttctgttgcctgaacctgcgggttctgacctagaagttcgtccccaacttcaaggtcccgtgatttggggcacctttttcct

SEQ ID NO: 82317 - DNA, 601 bp, Human
acgagaatgttagggagctagattactccattagcactgaatgttaattttccagattgtagcttgatttccaggacaatgaaagccttctccttccctatgatatcactgaaggactgataagaagttagggataggaagaaagattaaagttggaagtaatgataggtattaaaatcagtaaacctctaaatgcccaaattctgccttgacaattgctgttccccaggtggtttggaggtagacatactcacaaaagaaaacaaacgcccgttcttattaactaaacttgagcaaatargatctctctttagctaactgggctggagcacaaatggatggggttagaccaaaggacgtctctccctttctcaagccatcatcatttggacttgaggaaggacagtgtattgaagaaatgagagtcctagaatgtgtttaagatactagaagacagaagcatatggccaaagagcctctgggcaaagtgcctactagttgagccattcatttgcttttgaaggtgatcttgtaatagagtgatcctgctcactagtaatgcggcccagtgagcatccaggaatctggttgagcaattcag

SEQ ID NO: 82318 - DNA, 601 bp, Human
tgtaatccatatgtctatgactcatttaaatgcaactcagtgaagcatggtttactaagagcattgggataccatctaagcctttctaagctgctctttgatccaggaaattgaattttgccaacaacaaatgaagctcctgacaagagagggtcaaagagagctgtcctttatcctaggtaagatgttaaagtctactcttgacctgggaggaagctgggagggtggaggtggggagagctccactgcctaagtggtattcatagttttgctttgggtctgctactatttctaccaggtmtccttgaaaaagaagtgcaggaataagagatggcaactaatctgccccgtgtgttgctgaaaaattcctttcctgcctgctaattctgcccttcctcaattccaccagtattatgcaatccaaattgtataatggacttgaggaaaaacgagaatgttagggagctagattactccattagcactgaatgttaattttccagattgtagcttgatttccaggacaatgaaagccttctccttccctatgatatcactgaaggactgataagaagttagggataggaagaaagattaaagt

SEQ ID NO: 82319 - DNA, 601 bp, Human
atgtgaagaaaatttcagacaccacaggcagctctcatcaaattctggtgtccccacccattcatccaactgtttcctcagcacctgtctccccgggttatacaaccttagccatggggaatggggagcccagctgcgagtagagtttggaaaaacattttgaatactttagatctgccaaatacttggttaaagaatgatatcctttaatttcttgagccatgtgtattttaagtgcaatgtaatccatatgtctatgactcatttaaatgcaactcagtgaagcatggtttactaagarcattgggataccatctaagcctttctaagctgctctttgatccaggaaattgaattttgccaacaacaaatgaagctcctgacaagagagggtcaaagagagctgtcctttatcctaggtaagatgttaaagtctactcttgacctgggaggaagctgggagggtggaggtggggagagctccactgcctaagtggtattcatagttttgctttgggtctgctactatttctaccaggtatccttgaaaaagaagtgcaggaataagagatggcaactaatctgccccgtgtgttgctga

SEQ ID NO: 82320 - DNA, 601 bp, Human
aaaggccccacctcctaataccatcaccttggggactaggacttcaacataagaatttgaagggagacataaacattcagtacattgcaaatggagaccctgcttatgctggggtggggttgagagtttggcttataaaaaatcacatcagactggctggcaatccatttgttctgcaactccaggcatttgggacaacatgggaaatgcaaatgaaatcattctcagtctacaaagctacaattagaaactacatctcaaacaggactaccaggtctctctggaatgacgtgcctagcawagcacttggaatttaaatccactcatgcattcactgccttcagcgtcaacacagcagggttaaaccagttcttcatacttccaaagaacatgtgaagaaaatttcagacaccacaggcagctctcatcaaattctggtgtccccacccattcatccaactgtttcctcagcacctgtctccccgggttatacaaccttagccatggggaatggggagcccagctgcgagtagagtttggaaaaacattttgaatactttagatctgccaaatacttggttaaagaatgatatcctttaat

SEQ ID NO: 82321 - DNA, 601 bp, Human
atcatatccaaaaggccccacctcctaataccatcaccttggggactaggacttcaacataagaatttgaagggagacataaacattcagtacattgcaaatggagaccctgcttatgctggggtggggttgagagtttggcttataaaaaatcacatcagactggctggcaatccatttgttctgcaactccaggcatttgggacaacatgggaaatgcaaatgaaatcattctcagtctacaaagctacaattagaaactacatctcaaacaggactaccaggtctctctggaatgacstgcctagcaaagcacttggaatttaaatccactcatgcattcactgccttcagcgtcaacacagcagggttaaaccagttcttcatacttccaaagaacatgtgaagaaaatttcagacaccacaggcagctctcatcaaattctggtgtccccacccattcatccaactgtttcctcagcacctgtctccccgggttatacaaccttagccatggggaatggggagcccagctgcgagtagagtttggaaaaacattttgaatactttagatctgccaaatacttggttaaagaatgat

SEQ ID NO: 82322 - DNA, 601 bp, Human
ccttcagatcaccaggcttattactgagtctgagcttaagcaatggaccctaagaaagtgatatcatgtgtccaatattttagaaataatggcatcttagtccattctggctgctataacaaaacagcataacctgggtagcaaataagcaacaaatttacttctcacggttctagagtctgagaagtccaagatcaagggatcagcagatttcgtgtctagtgagggccctctctccggttcatagatggtagctgctagctgtgtcttcacctggtggaaaaggtgagctaattctctsgggtctcttctatcagggcactaatcctattcatgagagcagagccctcataaacgaatcatatccaaaaggccccacctcctaataccatcaccttggggactaggacttcaacataagaatttgaagggagacataaacattcagtacattgcaaatggagaccctgcttatgctggggtggggttgagagtttggcttataaaaaatcacatcagactggctggcaatccatttgttctgcaactccaggcatttgggacaacatgggaaatgcaaatgaaatcattctcagtctac

SEQ ID NO: 82323 - DNA, 601 bp, Human
ggcttgtgtgcacaaggctttcagaatcaacacatctaggctatttcaattttggatgctctctgataccttagacaagcgtatcatgaagctgcatcccttcagatcaccaggcttattactgagtctgagcttaagcaatggaccctaagaaagtgatatcatgtgtccaatattttagaaataatggcatcttagtccattctggctgctataacaaaacagcataacctgggtagcaaataagcaacaaatttacttctcacggttctagagtctgagaagtccaagatcaagggaycagcagatttcgtgtctagtgagggccctctctccggttcatagatggtagctgctagctgtgtcttcacctggtggaaaaggtgagctaattctctcgggtctcttctatcagggcactaatcctattcatgagagcagagccctcataaacgaatcatatccaaaaggccccacctcctaataccatcaccttggggactaggacttcaacataagaatttgaagggagacataaacattcagtacattgcaaatggagaccctgcttatgctggggtggggttgagagtttggctta

SEQ ID NO: 82324 - DNA, 601 bp, Human
gtgatccacccggctcagcctcccaaagtgctaggattacaggcatgcgccactgcacctggccaagtagtattactatgaatacagatgaagaagtaaaacttagaaggcaagtgacttaccaaagaccacccaaccggaagtgtcagtatctggaattgaatcagggtctctgggaccaaagtccaaatctgttctactctatggattaggatgtttaaggcttgtgtgcacaaggctttcagaatcaacacatctaggctatttcaattttggatgctctctgataccttagacaagygtatcatgaagctgcatcccttcagatcaccaggcttattactgagtctgagcttaagcaatggaccctaagaaagtgatatcatgtgtccaatattttagaaataatggcatcttagtccattctggctgctataacaaaacagcataacctgggtagcaaataagcaacaaatttacttctcacggttctagagtctgagaagtccaagatcaagggatcagcagatttcgtgtctagtgagggccctctctccggttcatagatggtagctgctagctgtgtcttcacctggtggaa

SEQ ID NO: 82325 - DNA, 601 bp, Human
cagagtttgactcctggctatgcccaatactgggtaaattatttaaactcctcatgcttgagtttcattataaaatgcagacaacaatatctcattcaaagggttgccatgaggattcaataagacattgtgtgaagtgccttttccgaagtatccattctcagcaaatgctcacaaagcagtgagtattattactattatttgagacagcatctggctctgtcaaccaggctagagtgcggtggtatgatctcagctcattgcaaccttcacctcctgggctcaaaagatcctcccactmaagcttcctgagtagctgggactacaggcatgtgccaccatgcctggctaatttttgtgggggttttttgtttgtttggttggttggttttggtagagacagggttttgccacattgcccaggctggtctcgaactcctgggctcgcgtgatccacccggctcagcctcccaaagtgctaggattacaggcatgcgccactgcacctggccaagtagtattactatgaatacagatgaagaagtaaaacttagaaggcaagtgacttaccaaagaccacccaaccggaagtgtcagtatc

SEQ ID NO: 82326 - DNA, 601 bp, Human
cctgttctgtctatagtcaaatctccttctgcctccctcttataaatatatttgccattgtatttagggcccatccaggtaatccaagataatcttctcatctcaagatctttgattttgttgttgttgttgttgctgttgtttgagacggagtctcgctctgtcgctgaggctggagtgcagtggtgtgacctcagctcactgcaacctctgcctcccaggctcaagtgactcttctttactgcaacctgttttatcagcaaggtttttataacctgtttttttttctttttcttttttyttttttttttttttttttgagatggggtctcactctattgcccaggctggagtgcagtggcacaatctcggctcactgcaacctctgcctcccgggttcaagcaattcttctgcctcaacctcccgagtagctgggactacaggggcgcaccaccatgcccagctaatttttgtatttttagtagagaccaggtttcaccatgttagtcaggctggtctcgaactcctgacctcaggtgattcacctgccttggcctcccaaagtgctgggattacaggcgtgagccaccatgcccggcc

SEQ ID NO: 82327 - DNA, 601 bp, Human
tgtaaatcctttaagagcattacgttattgaattccacacacatcctatgaggttattatccccatcacgtagatgagaaaactgagactctcaaaggttgagcgacttgccaaagcttacacctccaggtagtgcaaggagccaagcttgggatgcacacctgcctggattacactatcacattacactgacatgcaaattctaaccagggcctgggaaaggtaggaggaaagggaagggggagagtagaacaatgaagaagaaatgccagtgctaaccaaaaaagagcccaaagcatamtgagccaggactatgcatctgagaggcaatatactgccccagttaaaagcctggacttgggagtcaaacagatctagtttcacatcctggccctgctcttcccacccacatgacttttagcaagtcacactgctccacacctcagggtccccatctgccaaatagggctaatataggaatctactcttcattggttggttgtgacaagtgaagtagatgacccatataaataccacagtacgatgcctgttatacaggcatctcctactttttagctatcaccatttgttaatatgtgac

SEQ ID NO: 82328 - DNA, 601 bp, Human
gggttttaaggtcaactcttcttaattacatttggaaaccaactcaggggaattccctctgacttcattcttaaatgcttttctgaccctgcaaaacacaaataacagtgtctatttattgtgctctcatagtgcaccaggcaccctgtaaatcctttaagagcattacgttattgaattccacacacatcctatgaggttattatccccatcacgtagatgagaaaactgagactctcaaaggttgagcgacttgccaaagcttacacctccaggtagtgcaaggagccaagcttgggakgcacacctgcctggattacactatcacattacactgacatgcaaattctaaccagggcctgggaaaggtaggaggaaagggaagggggagagtagaacaatgaagaagaaatgccagtgctaaccaaaaaagagcccaaagcataatgagccaggactatgcatctgagaggcaatatactgccccagttaaaagcctggacttgggagtcaaacagatctagtttcacatcctggccctgctcttcccacccacatgacttttagcaagtcacactgctccacacctcagggtccccat

SEQ ID NO: 82329 - DNA, 601 bp, Human
cagaggctgggaagggtgtagtggggagatgcagatagttaatgggtacaaaaaagaatagaaaaaatgaataagacctattatttgatagcacaacaaggtgactacagtctataataatttaactatacattttaaaataaagagtataattggactgtttgcaatgcaacggataaatgcctgatggaatggatacccttttcttcatgatgtgcttatttcacattgcatgtttgtatcaaaatatctcttgtaccccgtaaatatatacacttactatgtatgtactcacaaaaawtaaaaattaaaaaaggaaaagataaaattactgagatttgtttcatgggctaaaaagtaagtaaaaatagaacttctaattaatttttttaaatatgataaaggtacatggagacatatttataatatgctcataatgtgaaatggtacattcaacctttggggaggtatctgttgttgtataaatgcaaaatggtacattcagcctttggggaggtatttgtggagtgagaggtacaacttgtcaaaatttaaaagcgttttaattgtgtactccataggatcctgtaactctacatct

SEQ ID NO: 82330 - DNA, 601 bp, Human
cagcctgggggacagatcaagactctgtctcaaaaaacaaaacaaagcaaaacaaaaaaaaccgcaatgagatatcatctcacccagttgaaagataggcaataataaatgctggtgaggatgtggggaaaagggaacccttgtgtacgttgctggtgggaacataaattagtacaaccactatgtcatgctaccatatgatccagcaatcccactgctgagtatagacccaaaagaaaggaaatcagtgggccaggcacggtggctcatgcctgtaatcctagcactttgggaggctgargtgggtggattgcctgagcttaggagttcaagcccagcctgggcaacaggagtttgagaccagccagggcaacaaggtgaaaccccgtctctactaaaaatacaaaaagttagccgggcatggtggtgtgtgcctgtagtcccagctactcgggaggctgagacaggagaattgcttgaacctgggaggtggaggttgcagtgagccgagattgtgccattgcattccagcctgggtgacagagcgggactctactcaaaaaaaaaaaaaaaaaaaaaaaaggaaatcagtatactgaag

SEQ ID NO: 82331 - DNA, 601 bp, Human
ggcaaaagctttgaatagacatttctcaaaagaaggcataaaaatggcaaacaagcatatgaaaaggtgctcaacatcactgatcttcagagaaatgcaaatcaataccacaacaagctgggtgccttgactcatgcctgtaatcccagcactttgggatggatcacttgagaccaggagtttgagactagcctggtcaacatggcaaaacttcatctctactaaaaatacaaaatgcaaaaaaattaaccaggtgtggtggcgtgcacctgtagtcccagatactcaagagactgaggcwcaagaatcgcttgaacccagaaggcggaggttgcagtgagccaagatcgcaccactgcactccagcctgggggacagatcaagactctgtctcaaaaaacaaaacaaagcaaaacaaaaaaaaccgcaatgagatatcatctcacccagttgaaagataggcaataataaatgctggtgaggatgtggggaaaagggaacccttgtgtacgttgctggtgggaacataaattagtacaaccactatgtcatgctaccatatgatccagcaatcccactgctgagtatagacccaaaagaa

SEQ ID NO: 82332 - DNA, 601 bp, Human
gatcacaacaagttaaaaagcttctgaacagcaaaggatacaatcaacaaagtgaagagacaacccaaacaatgggagaaaatatttgtaaactacccatctgacaagggcttaataacaagactatataaggagctcaaacaactctataagaaaaaaaaaaactaataatccaatcaaaagttgggcaaaagctttgaatagacatttctcaaaagaaggcataaaaatggcaaacaagcatatgaaaaggtgctcaacatcactgatcttcagagaaatgcaaatcaataccacaacragctgggtgccttgactcatgcctgtaatcccagcactttgggatggatcacttgagaccaggagtttgagactagcctggtcaacatggcaaaacttcatctctactaaaaatacaaaatgcaaaaaaattaaccaggtgtggtggcgtgcacctgtagtcccagatactcaagagactgaggctcaagaatcgcttgaacccagaaggcggaggttgcagtgagccaagatcgcaccactgcactccagcctgggggacagatcaagactctgtctcaaaaaacaaaacaaagcaaaa

SEQ ID NO: 82333 - DNA, 601 bp, Human
ggatcacaacaagttaaaaagcttctgaacagcaaaggatacaatcaacaaagtgaagagacaacccaaacaatgggagaaaatatttgtaaactacccatctgacaagggcttaataacaagactatataaggagctcaaacaactctataagaaaaaaaaaaactaataatccaatcaaaagttgggcaaaagctttgaatagacatttctcaaaagaaggcataaaaatggcaaacaagcatatgaaaaggtgctcaacatcactgatcttcagagaaatgcaaatcaataccacaayaagctgggtgccttgactcatgcctgtaatcccagcactttgggatggatcacttgagaccaggagtttgagactagcctggtcaacatggcaaaacttcatctctactaaaaatacaaaatgcaaaaaaattaaccaggtgtggtggcgtgcacctgtagtcccagatactcaagagactgaggctcaagaatcgcttgaacccagaaggcggaggttgcagtgagccaagatcgcaccactgcactccagcctgggggacagatcaagactctgtctcaaaaaacaaaacaaagcaaa

SEQ ID NO: 82334 - DNA, 601 bp, Human
ctcctggcttctgagttccttcgcctgtggtggcataactctaatcttcacatggcattctcccagagtgtgtgtctgtttccaaacctcccccttctaaaaggacaccactcatgctggattagagacctgccatactccagtatgatctcatcttaactaaatacatccacaactcaatttccaaataaggtcactttgaggtactggggataaggacttcaacatatgagtttggggggacaccattcaactcataacactgctgatgttttttccttttggagtggtgaaaatgttytaaaatcagattatggcgatggctgcatgactttgtaaatatactaaaacagatgaaattgtatactttaaatgagtgaactatatggtatgtgagttgtatctcagtaaagctgtttggaaaaaaaaaaaaaaagacaagagagcttgggtttaaagagtctgcccaagctcaataatcaactcaatggtgtgtttgggaaaacaggatctctcaacaagggcagtgagatataaacttgcagaggagccaagggcaacttgcctttatatatccacgttacatgtaaattcgctttga

SEQ ID NO: 82335 - DNA, 601 bp, Human
tcccttgaaaccaccctctccctcagcccacatgcaacccatttcccagtttccatgattccaccctataaatatctctggaatctatcctcttctctttatatcagctacctcttccctaaattagtccttctcaaatgcgttttggatgctgtcactatgtgacttttaaaatattcttcatccgcttcccattgccctagagataaaagcccaaactctttaaggtgcctacaaggccctttaaggactcacctctgcctgcctcaccaatttcttctctcatcatttccttcctcckgctctctgttctaactatagagaacttttcattttcaatgtcattcttgcctttgggcctttgatcctgtgatctgtgctgcctggcacatactccctattgtatgagccaactctgccacactctccaccaccatcacactcccccttttctttacttcctcctatcagacttcccgtgcccccaatccagaggaagttccccttccccatgttcctacagtaccctctacttcctccctcctagcaggtcccacattgttctgtaactgtttaattatctgtcccctctactacgttc

SEQ ID NO: 82336 - DNA, 601 bp, Human
gtttctaaacccatcatttcaataaactagagtaagctaaatgtcagtggtagacaagccaagagttgggccatccagacacacccagtaggcagagagaaaggctcttcatgcaatctcatgaataactgcatattaagcagtgtaatgtggtacaaactgcaggccacctggcatcaggaggccagagtttctcacagcttgatttcgtcactatttgctgggggtccttgatcaagacgcagcacctttctgagcatcaggccttgcaggccctgcacctgcaagtccacttgcaccytccacaaacatgtatggaggtccgtgatgtgcaggcactatgctaggggatggggcttcagcagccagtgaggcaggcctaggtttcctgcccctctcctggcttggcacctgcagctcccaagtgcttggcaaatgctgacaccatgcagagggcaggtgtcactgtctggtccccagaaggcactgtttcacagctcatcttccttcctggaacagctgcaaaccagtgtggtaaccaatttctagtttctcctaaaaagctgtctacacagttatggagaagggatgtatatgtgca

SEQ ID NO: 82337 - DNA, 601 bp, Human
tttgtgctttacaaatattgctatcattttctccagcactagctatatatacacgtggcaaaatcttgatcattgttaaatctaggtaatgggcatctgaggtttataatactagtctctctccttctgggtttgtaaattttgacaatattttttaactggctaggtgatacggtgcaagtcacaaactactcagcctcagtttccctttctatcaagcagaaatggcaatgcccaggacagacaggtactggaaagtgtctctgaaaagcagagtgctattctaatgtcatggcctgcmctagtctagatttgggacaaaataaattcagtgagtattgttttgttttctaagatgctgaaagaaaagcagggaagagacagccagagctgcttcagaaccaagatttctacatcagtactcattccacctctgactccaaaggaatggaaacaaaccaacgtgccaaaggcatggccctaaagccaaataagggactgatgagtccagggggctgcaagcagacacattcctttatgagggaacagaaaggcgaaggaagggggaactttggaggttgctcctagagtaaaaaattgg

SEQ ID NO: 82338 - DNA, 601 bp, Human
ctgtaagatgttagaatagtgcctggcatataggaagatcatatgaacaaatgtgaaagaattatttgtaaagtagaaagtatttgtgctttacaaatattgctatcattttctccagcactagctatatatacacgtggcaaaatcttgatcattgttaaatctaggtaatgggcatctgaggtttataatactagtctctctccttctgggtttgtaaattttgacaatattttttaactggctaggtgatacggtgcaagtcacaaactactcagcctcagtttccctttctatcaarcagaaatggcaatgcccaggacagacaggtactggaaagtgtctctgaaaagcagagtgctattctaatgtcatggcctgcactagtctagatttgggacaaaataaattcagtgagtattgttttgttttctaagatgctgaaagaaaagcagggaagagacagccagagctgcttcagaaccaagatttctacatcagtactcattccacctctgactccaaaggaatggaaacaaaccaacgtgccaaaggcatggccctaaagccaaataagggactgatgagtccagggggctgc

SEQ ID NO: 82339 - DNA, 601 bp, Human
agccttagactctcagaggcctgtctacggttctctggactttatgggaagagtgtggctttgaaagatgtactatttacaattaattaggacagcccttgttccactctgtaaaatcagatgttaacttgtaaaaacttaataagatacaacagaaatgcaaatatttccatctagtagaaaagataaccccaaaggttatgattttacagcccctaggatattaactagttttgtgtctaatttagcaatcttatctcagcattccttttttcactattaaatacacacacacccccamacaaatacgtcttagtttcccttatccaattttaaaccagttttatcatcttgctggttagcccattaattagataaataaaacttcgagaagtgctcactatgtatttgtataaaaattgttttcacgtgagccacataaaccccctccattttctagactgcaaaatgaacagactaataatcaccatcagtatcacagcgatgctgaggatcaaatgagaaaatacattcaaatcctagctcttataagtcgtgtgaattcagactggtcagtaacttctccgtgcctatggtttct

SEQ ID NO: 82340 - DNA, 601 bp, Human
tctgctcatctcagtagcaagttttgctgacacctcctttctctgggcctttctctatctaattcttccaagagtctccaggcatttataccctgatgatgccttgggaggtccacttttctggtctctcttatttcacctggagggtcttcatcctgcctatgttagtaataatgttctcaccatgcgacttagcccaacaactgcacaacacctggaaagactgttcaaaaatacacaatcccctcccttttctagggaaggattaagaaatctgtatttttaatagttttttttttttcaggtgatttatgttttcgggttctgggaattattctactccatttgagcaattttaacatttttaattcttttttttatttctagcctcctaatcaccttccaaaagtctaaagatggtgctaacccagcatagagggaaagtcggaatgctttggtttaagcagcagctgcactaggcaactgcccttccaaagcctggaaatgaagcaaaagatgactatggttcctctcaatgtcacacaagcgtacagccagggctgggtgcaatggctcacgcctctaatcccaggactttggg

SEQ ID NO: 82341 - DNA, 601 bp, Human
tgtacagctggtcaggagttcagagtttaatagttcattccaggtgccagtggggaagtgtgaattttcccacagaaaatgcactcctggtaaaaatattctcagcctcttctgagacttagcaaggggggagaaatcattcacccagtgacattaccccatcatcacaggcctctctgaccctcagcactgaaaggaaccctagaaatcatgtagtcaaaccccaattacactgtgagctccccaaaaacagggaccttgtgtctttgaagtcttctccccggcccccagcacctagcargcaggcagtacatgtgcattctgtgaatgagtgaataaactcgcaaacgaatgaatgaaccttttatctcgtgtaggaatctgccaaatggctattcaccactggacacctccagggagaggctactcctgagactacccactccatttctgaccacatacagtagtttaatgttttactccggattaaaaactacacctctgtcactggcacccacaggccttcattctggcctctgaatctacataaaacaatccgctttcattttccacctaatcaccctttctgaagcagcaatat

SEQ ID NO: 82342 - DNA, 601 bp, Human
ttccagctctaagttctgggatcgctcagatttccctccatccccagtgtgtggtcagaaggcaaatgccacaagaattgtctcctgtactatgtcaaggccttcaacttctcgccttggacaagaagaaaagaagcccaacaggaaaatgtaaaaataaagcaaagcacaaaccccagctttgtgaagagaaattctcattcacatggaaactttgggtcagtggctaacctgccagaatctgtctcccagtcctttctctttctccttagcatctaactagtccaagatttgagggaggagtcacccatttgcctgagggagaaaagctgtaagcctcatgagggcagaggccaagcagttttgctcactggtttatgtcagtgcttaacatttgttcaatgagaaaaccacttaactagttaccgaatgaatggatggatgagtagttcagtgtactagcagcttagagcatggtctggagactggaaaactgaagttttgattccagctctgacattcactgcctctacggccgtgaacaagtacatgtatgtctctgaacctttgtttcctcttacacaaaaaagaggatgatata

SEQ ID NO: 82343 - DNA, 601 bp, Human
aagttggttgacttttaaattaactgtcagagaggtgttttgaaaactgaaattttaatttaaaactgctcttaaaaagaagaaaatgtaggctgaggccagcacagaaagccaaaggaatctgcagggataacccaggttttgaaagaggtgacatttcccagcaagagagggtcatcgcagagggtctctagaattcctctagagtcacttccagctctaagttctgggatcgctcagatttccctccatccccagtgtgtggtcagaaggcaaatgccacaagaattgtctcctgtaytatgtcaaggccttcaacttctcgccttggacaagaagaaaagaagcccaacaggaaaatgtaaaaataaagcaaagcacaaaccccagctttgtgaagagaaattctcattcacatggaaactttgggtcagtggctaacctgccagaatctgtctcccagtcctttctctttctccttagcatctaactagtccaagatttgagggaggagtcacccatttgcctgagggagaaaagctgtaagcctcatgagggcagaggccaagcagttttgctcactggtttatgtcagtgctta

SEQ ID NO: 82344 - DNA, 601 bp, Human
gaaagtcaaggtcagccaggtgtggtggctcacacctgtaatcccagcactttgggagactgaggtgggcagatcacctgaggtcaggagttcaagaccagcctggttaacatggtgaaaccccatctctactaaaattacaaaaattagccaggtgtggtagcaggtgcctagctgggaggctgaggcaggagaactgcttgaacctggggggtggaggttgcagcgagccgagatcacgtcattgcactccagcctaggtgacaagagcgagactctgtctcaaaaaaaaaaaaaaaaagagagagagaaacaaatgccctttgttgatggtgattatctcaggggttgcagaagatgtttacaatataagttgcatatttctgaagttggttgacttttaaattaactgtcagagaggtgttttgaaaactgaaattttaatttaaaactgctcttaaaaagaagaaaatgtaggctgaggccagcacagaaagccaaaggaatctgcagggataacccaggttttgaaagaggtgacatttcccagcaagagagggtcatcgcagagggtctctagaattcctctagagtcacttcc

SEQ ID NO: 82345 - DNA, 601 bp, Human
cagaccccttgaagtacaggttaagaatcccctcaccaaaggccaggcaacttcaagaaatgttcttagaattttctctaaaaattaaaagaaaaatataagagtcaaatggatgtttcaactattaatagttcagccacattaaaggcagaattgatctacagaaagtcaaggtcagccaggtgtggtggctcacacctgtaatcccagcactttgggagactgaggtgggcagatcacctgaggtcaggagttcaagaccagcctggttaacatggtgaaaccccatctctactaaaawtacaaaaattagccaggtgtggtagcaggtgcctagctgggaggctgaggcaggagaactgcttgaacctggggggtggaggttgcagcgagccgagatcacgtcattgcactccagcctaggtgacaagagcgagactctgtctcaaaaaaaaaaaaaaaaagagagagagaaacaaatgccctttgttgatggtgattatctcaggggttgcagaagatgtttacaatataagttgcatatttctgaagttggttgacttttaaattaactgtcagagaggtgttttgaaaactgaaa

SEQ ID NO: 82346 - DNA, 601 bp, Human
tcctaggagtagggctgggagaggacagctgctggatagacatttgttgacctgaactcacctccaatttccgtgtggtggtttgagggttaccacttgaagtataatgggtttctgtgtaggaaggagcaaaaagttgcctgcaaaaaataaaaagagacatttatatcataagtggatgaactccaccctcctagcaacaacgagtgattttaactgaaccaggcaggactatcccaagcatctccatacaaaagaaactaggcagccacaaggggctaaggaacaaaaaggaaaaccrtaagtttgttattaattttatatttaatgtaaattaaatataatttatcatcactatgggaacatcactccaactagatggaattgacagaactaaagcaatgatcttaatatttgtctgggtcctgggaaaacagacatgcaaacacatgcaaaatttcccggggcctatgaaccctgttgtgtaccgtggttgatttttccagcactggatctaccaatttttagtatcagcagaccaatttttctttaagggaataactcttccctgatgcatattttggtgagattgtcaatcaag

SEQ ID NO: 82347 - DNA, 601 bp, Human
agaacatgtatatttcacagtaatttgcatcaattgtaattagatgcaattaccctaaaatagtctatgtttctttagccattgtagtcagcaaaggaggaggagcacctatgaacatcaaatacatgttttgcttctcgtttgctcccttggtcttcgcttgggggaaacactcccttcagaggagagaccaactccatcaggcatctcctgaggtcctaggagtagggctgggagaggacagctgctggatagacatttgttgacctgaactcacctccaatttccgtgtggtggtttsagggttaccacttgaagtataatgggtttctgtgtaggaaggagcaaaaagttgcctgcaaaaaataaaaagagacatttatatcataagtggatgaactccaccctcctagcaacaacgagtgattttaactgaaccaggcaggactatcccaagcatctccatacaaaagaaactaggcagccacaaggggctaaggaacaaaaaggaaaaccataagtttgttattaattttatatttaatgtaaattaaatataatttatcatcactatgggaacatcactccaactagatggaat

SEQ ID NO: 82348 - DNA, 601 bp, Human
tgtctaccagtggagtgtggcaaagcaaactgacatgtaaccatctgaaagaccattttctaaatgaaagatctttgacattgcgtaaacatccctactcaaaaacaactttgagggaaaaaatgtccaatatgaatatagaagcaaaataaaatattcataacttaaaaatcacattaaaatagcagactacaaaatgtatatgcacagtgattacaactctgtaaatgttatacatccatttaaaaaggactaatcaaacatctaattggatgagacgacaggattatgagtaagtcaytccttttactaaaacttttgttaacatgtgggtaattaacataaagcaaagaacatgtatatttcacagtaatttgcatcaattgtaattagatgcaattaccctaaaatagtctatgtttctttagccattgtagtcagcaaaggaggaggagcacctatgaacatcaaatacatgttttgcttctcgtttgctcccttggtcttcgcttgggggaaacactcccttcagaggagagaccaactccatcaggcatctcctgaggtcctaggagtagggctgggagaggacagctgctgg

SEQ ID NO: 82349 - DNA, 601 bp, Human
tggttgagaatcaacgttctgagcctacaaattccaataggcatccctgtaagaagagctagccaccatgaaatgtgtatcattcactactttaaatgtctaccagtggagtgtggcaaagcaaactgacatgtaaccatctgaaagaccattttctaaatgaaagatctttgacattgcgtaaacatccctactcaaaaacaactttgagggaaaaaatgtccaatatgaatatagaagcaaaataaaatattcataacttaaaaatcacattaaaatagcagactacaaaatgtatatkcacagtgattacaactctgtaaatgttatacatccatttaaaaaggactaatcaaacatctaattggatgagacgacaggattatgagtaagtcactccttttactaaaacttttgttaacatgtgggtaattaacataaagcaaagaacatgtatatttcacagtaatttgcatcaattgtaattagatgcaattaccctaaaatagtctatgtttctttagccattgtagtcagcaaaggaggaggagcacctatgaacatcaaatacatgttttgcttctcgtttgctcccttggtc

SEQ ID NO: 82350 - DNA, 601 bp, Human
acacaaaattacctgtcctgtgtccctttccccatccaggggtaatctggcgaactaatctgagctgttaatgactgatagtggccagtgttatcttgctggacacttgcactccagcagggatattttaaagaatgggcctggtagaacactcaggttccatgagaagctgctgaaggagtcctgatgcagagggacctctcctgctgttctccacaccacaactcccagtctgtgtgcctcagtagtccattatgtcctgccccaaaggcaaaggccactgctgctcctgccagtgtgygtcttcccttcttcacccccatctcaccagcccagactttgagaatggtcattcgaatccagggtttctcaacttgggcactatggatatttggagctggataattctgttgtgggggagtggtgggtctgtcctatgcattatagaatgtagatgccagtagatcctccctgccagtcacggcaataaaaattgcctgcaaacattgccaggtgtccctcggggtcggggcaacgccattggttctcctggttgagaatcaacgttctgagcctacaaattccaataggcatccctgta

SEQ ID NO: 82351 - DNA, 601 bp, Human
ccagaactccagctaccccaggccaagtttggtagtagagtgcagtctccaacattcgggtcaagggcagctgagtagtttattccattcccatttttcattgagctctcagctcccaaatgggaagtctgactgagaaccccatgggcctgggtgggagctttgcaagagtctagtagcaggggatgtaagcaaacaatgagttgtccatcccaaggttcagctaggatgtgcttcagtcaacaagaccttctggaaggaggggattctgggagagggggagttcttttccaatcctctytttctgaaaggcccttacaacatctctgcctaatgcacaagcagagagcacaaagaacaagtcaaggatcagtcatgaagtcattgcattcctcagcttctcagcctgatggggccaccccaagggggctttcatagcaggaagcgtgagctcatggcaaattcgtggactgagacccattcttgagctgtgggtacagaagtggcaggatccaaactcagaggagagtgtttgaaggaggctgtcatggctaacagctttctaggcatgcctgttcccccatcccacccctgcccctgg

SEQ ID NO: 82352 - DNA, 601 bp, Human
ccattcccccaaccgcctgacctagatgcaggctgtcgcctaaaggcctgactgatgagtcttgataaggttcccagaactccagctaccccaggccaagtttggtagtagagtgcagtctccaacattcgggtcaagggcagctgagtagtttattccattcccatttttcattgagctctcagctcccaaatgggaagtctgactgagaaccccatgggcctgggtgggagctttgcaagagtctagtagcaggggatgtaagcaaacaatgagttgtccatcccaaggttcagctagratgtgcttcagtcaacaagaccttctggaaggaggggattctgggagagggggagttcttttccaatcctctctttctgaaaggcccttacaacatctctgcctaatgcacaagcagagagcacaaagaacaagtcaaggatcagtcatgaagtcattgcattcctcagcttctcagcctgatggggccaccccaagggggctttcatagcaggaagcgtgagctcatggcaaattcgtggactgagacccattcttgagctgtgggtacagaagtggcaggatccaaactcagaggaga

SEQ ID NO: 82353 - DNA, 601 bp, Human
tcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataaggttcccagaactccagctaccccaggccaagtttggtagtagagtgcagtctccaacattcgggtcaagggcagctgagtagtttattccattcccatttttcattgagctctcagctcccaaatgggaagtctgactgagaaccycatgggcctgggtgggagctttgcaagagtctagtagcaggggatgtaagcaaacaatgagttgtccatcccaaggttcagctaggatgtgcttcagtcaacaagaccttctggaaggaggggattctgggagagggggagttcttttccaatcctctctttctgaaaggcccttacaacatctctgcctaatgcacaagcagagagcacaaagaacaagtcaaggatcagtcatgaagtcattgcattcctcagcttctcagcctgatggggccaccccaagggggctttcatagcagg

SEQ ID NO: 82354 - DNA, 601 bp, Human
ctggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaatgtggggttggaagagttgcttatgaattcccataaaaattagtgattcatcttacccttccacagccctgcgagtcagatatcagcatatscaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataaggttcccagaactccagctaccccaggccaagtttggtagtagagtgcagtctccaacattcgggtcaagggcagctgagtagtttattcca

SEQ ID NO: 82355 - DNA, 601 bp, Human
tattgccatgttttaaagggggaaattgaaagagaggttttaagtcattcacaaggtgacacagcaaagtggatactggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaatgtggggttggaagagwtgcttatgaattcccataaaaattagtgattcatcttacccttccacagccctgcgagtcagatatcagcatatgcaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataaggttcccagaactccag

SEQ ID NO: 82356 - DNA, 601 bp, Human
gaggcagatattattattgccatgttttaaagggggaaattgaaagagaggttttaagtcattcacaaggtgacacagcaaagtggatactggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaatgwggggttggaagagttgcttatgaattcccataaaaattagtgattcatcttacccttccacagccctgcgagtcagatatcagcatatgcaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataaggt

SEQ ID NO: 82357 - DNA, 601 bp, Human
tgaggcagatattattattgccatgttttaaagggggaaattgaaagagaggttttaagtcattcacaaggtgacacagcaaagtggatactggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaatrtggggttggaagagttgcttatgaattcccataaaaattagtgattcatcttacccttccacagccctgcgagtcagatatcagcatatgcaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataagg

SEQ ID NO: 82358 - DNA, 601 bp, Human
atgaggcagatattattattgccatgttttaaagggggaaattgaaagagaggttttaagtcattcacaaggtgacacagcaaagtggatactggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaawgtggggttggaagagttgcttatgaattcccataaaaattagtgattcatcttacccttccacagccctgcgagtcagatatcagcatatgcaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataag

SEQ ID NO: 82359 - DNA, 601 bp, Human
tatgaggcagatattattattgccatgttttaaagggggaaattgaaagagaggttttaagtcattcacaaggtgacacagcaaagtggatactggaaccccagcagcctggccccaagctccatcctctgcctctcccagcagtagcaaaggaggaacttggcttgtcagagctcttttatccccaccttctctagcaacaaaggagacaagttctagcctaagccttgccacttactggttaactgaacttgggcaagttacttttccccttctcctctcagtttcctcatctgtaaaatgtggggttggaagagttgcttatgaattcccataaaaattagtgattcatcttacccttccacagccctgcgagtcagatatcagcatatgcaatttgcaaatgagaaaactcaacactagtgtggtcaagggggttgtttaaggtcatataactagttaaagccaagataacaaccctggctgcagattgcaaaccctgtcatcctttctgttggaacacattcacagacccattcccccaaccgcctgacctagatgcaggctgtcgcctaaaggcctgactgatgagtcttgataa

SEQ ID NO: 82360 - DNA, 601 bp, Human
cactttgggaggtcaaggtgggcgaatcatgaggtcaagagatctagaccatcctggccaacaacacggtgaaaccctgtctttactaaatatacaaaaaattagctgggcatggtggtgcactcctgtcgtcccagctactcggagactgagggaggagaattgcttgaacccaggaggcggaggttgcagtgagccgagatggcaccactgcactccagcctggtgaccgagcgagactctgtctccaaaaaaagaaaaaagaaagaactgaaacccagggatggctgtgaagaatccytgcacctcttcctatctttgaatggatgctaagagtgttcacagccctagttctctcgaaaatagagcacctggcttctgtagcatgctttataatttacagagctttcacatacactatctcttgtgatgatgacacctacaacttactattattaacagtaagaggtcgggtggggtggctcacacctgtaaccccagcactttgggaggccgaggcaggcaaatcacttgaggccaggagtttgagaccaccttagccaacatggtgaaactccatttctactaaaaatacaaaaat

SEQ ID NO: 82361 - DNA, 601 bp, Human
aatgagttgaatagaatccccctaaaattcatgtccacctcagaatgtgatttatttggaaatagggtcttgcagatgtagttaaattaaggtgatgtcatgctgggccaggcgtggtggctcacacctgtaatcccagcactttgggaggctgaggcagatggatcacttgaggtcaggagttccagaccgccctggccaacatggtgaaaccctgtctctactaaaaatacaaaaatcagccggatgtggtggtgcacacctataatcccagctactcgggaggccgaggcaggagaaytgcttgagtccaggagatggaggctgcggtgagccaagatcgcaccattgcactccagcctgggcgacagagtgagattctgtctcaaggaaaaggaaaaaaaaaaaaaagatggtgtcatgctgaattagagaaggtcctaaatccaatgatttgtgtccttctaacaagagggaaggacacacagacacacacacagaaagagaagaaggccatttgaagatgggggcagagactggagtgatgaagttgcaagccaaggaacaccaaggatggccagaagccaccagaagctagaag

SEQ ID NO: 82362 - DNA, 601 bp, Human
agcatgccatggaaagaacttgcctccccaccaatgttatctttgcaaccccctgcaatgagttgaatagaatccccctaaaattcatgtccacctcagaatgtgatttatttggaaatagggtcttgcagatgtagttaaattaaggtgatgtcatgctgggccaggcgtggtggctcacacctgtaatcccagcactttgggaggctgaggcagatggatcacttgaggtcaggagttccagaccgccctggccaacatggtgaaaccctgtctctactaaaaatacaaaaatcagccrgatgtggtggtgcacacctataatcccagctactcgggaggccgaggcaggagaattgcttgagtccaggagatggaggctgcggtgagccaagatcgcaccattgcactccagcctgggcgacagagtgagattctgtctcaaggaaaaggaaaaaaaaaaaaaagatggtgtcatgctgaattagagaaggtcctaaatccaatgatttgtgtccttctaacaagagggaaggacacacagacacacacacagaaagagaagaaggccatttgaagatgggggcagagactggagtga

SEQ ID NO: 82363 - DNA, 601 bp, Human
agaattttcctagttcagggctctttcaggaatcagtgttttctgtggccaaaagcatgccatggaaagaacttgcctccccaccaatgttatctttgcaaccccctgcaatgagttgaatagaatccccctaaaattcatgtccacctcagaatgtgatttatttggaaatagggtcttgcagatgtagttaaattaaggtgatgtcatgctgggccaggcgtggtggctcacacctgtaatcccagcactttgggaggctgaggcagatggatcacttgaggtcaggagttccagaccrccctggccaacatggtgaaaccctgtctctactaaaaatacaaaaatcagccggatgtggtggtgcacacctataatcccagctactcgggaggccgaggcaggagaattgcttgagtccaggagatggaggctgcggtgagccaagatcgcaccattgcactccagcctgggcgacagagtgagattctgtctcaaggaaaaggaaaaaaaaaaaaaagatggtgtcatgctgaattagagaaggtcctaaatccaatgatttgtgtccttctaacaagagggaaggacacacagacac

SEQ ID NO: 82364 - DNA, 601 bp, Human
ctctgcccgctgaccaaccccagtgcctccccgtgccgccccccatggcacagccgggcccctcccttttctgtgagtatgaccatcttttcaatggcagtcatctcctgattttttggccttaccatacctaaataataacaaaacctatattttaaaacatcaagttcatcaggaaagttaaatcccaatggatttctggattacctaggctttcccttgcccatcctcccaggctcagcccctctctgggctggcttgcacacattctcaatggactccttcccaaggtccttgcctyagccttgtctatcttgaaacttccattcctggggagagtgcccggtgccacctgcagcctcagggtctcttacctaattcctcggcaagtgctgagcgtgacgctggacagttctgtctccctcaccgtgccgtggtaaaagcagtgatcctagcaaggagaaaggaggtggtcaggctaaagaacactgataagcatggcaatgttaatatctcaggatggtcatggatgactcatggcttattatatacctacccaaccttatagcaccttacaacctgcaaagagctttccaagcca

SEQ ID NO: 82365 - DNA, 601 bp, Human
ttagccaattcctagagatggtcaacaatttcccagctaccttgcctttcaaatgcaagccaaccaatccagagtccataccctagccatttattttatgggcactctcaccctctgggccactatcccccttccctaatcaccccagaaccaggtataggacaactaaggacagagagcccataaaccccagagcctgctgaaatgatgcaaactagccaatcctaaacctgctttctctgcctcgcccattccttcccgcagaaaccacaagaagggcgtctgctgacatttctccagrctccctctgcccgctgaccaaccccagtgcctccccgtgccgccccccatggcacagccgggcccctcccttttctgtgagtatgaccatcttttcaatggcagtcatctcctgattttttggccttaccatacctaaataataacaaaacctatattttaaaacatcaagttcatcaggaaagttaaatcccaatggatttctggattacctaggctttcccttgcccatcctcccaggctcagcccctctctgggctggcttgcacacattctcaatggactccttcccaaggtcctt

SEQ ID NO: 82366 - DNA, 601 bp, Human
agggactgccccttccaggattagccaattcctagagatggtcaacaatttcccagctaccttgcctttcaaatgcaagccaaccaatccagagtccataccctagccatttattttatgggcactctcaccctctgggccactatcccccttccctaatcaccccagaaccaggtataggacaactaaggacagagagcccataaaccccagagcctgctgaaatgatgcaaactagccaatcctaaacctgctttctctgcctcgcccattccttcccgcagaaaccacaagaagggcrtctgctgacatttctccagactccctctgcccgctgaccaaccccagtgcctccccgtgccgccccccatggcacagccgggcccctcccttttctgtgagtatgaccatcttttcaatggcagtcatctcctgattttttggccttaccatacctaaataataacaaaacctatattttaaaacatcaagttcatcaggaaagttaaatcccaatggatttctggattacctaggctttcccttgcccatcctcccaggctcagcccctctctgggctggcttgcacacattctcaatg

SEQ ID NO: 82367 - DNA, 601 bp, Human
ctactctctgttcattaaccgtccatttcctatttcaccacctccaagtacatctcccagagaagaactgaggaggtgtggaaccaaatgcccaaactcatccatcccgagcatattaaccatgtgtcttcttttttatcttctgtttctttgacatctgggtcttactgaccatagagggactgccccttccaggattagccaattcctagagatggtcaacaatttcccagctaccttgcctttcaaatgcaagccaaccaatccagagtccataccctagccatttattttatgggcrctctcaccctctgggccactatcccccttccctaatcaccccagaaccaggtataggacaactaaggacagagagcccataaaccccagagcctgctgaaatgatgcaaactagccaatcctaaacctgctttctctgcctcgcccattccttcccgcagaaaccacaagaagggcgtctgctgacatttctccagactccctctgcccgctgaccaaccccagtgcctccccgtgccgccccccatggcacagccgggcccctcccttttctgtgagtatgaccatcttttcaatggca

SEQ ID NO: 82368 - DNA, 601 bp, Human
cctactctctgttcattaaccgtccatttcctatttcaccacctccaagtacatctcccagagaagaactgaggaggtgtggaaccaaatgcccaaactcatccatcccgagcatattaaccatgtgtcttcttttttatcttctgtttctttgacatctgggtcttactgaccatagagggactgccccttccaggattagccaattcctagagatggtcaacaatttcccagctaccttgcctttcaaatgcaagccaaccaatccagagtccataccctagccatttattttatgggcactctcaccctctgggccactatcccccttccctaatcaccccagaaccaggtataggacaactaaggacagagagcccataaaccccagagcctgctgaaatgatgcaaactagccaatcctaaacctgctttctctgcctcgcccattccttcccgcagaaaccacaagaagggcgtctgctgacatttctccagactccctctgcccgctgaccaaccccagtgcctccccgtgccgccccccatggcacagccgggcccctcccttttctgtgagtatgaccatcttttcaatggc

SEQ ID NO: 82369 - DNA, 601 bp, Human
gctaccagctcaaagccaggtagtctcactcagagaaggaagggtcactctcaaaagcacattctggtcagaacttttcagttgattttctgtcttgaaaattatccttgcctttcctttcacttcctactctctgttcattaaccgtccatttcctatttcaccacctccaagtacatctcccagagaagaactgaggaggtgtggaaccaaatgcccaaactcatccatcccgagcatattaaccatgtgtcttcttttttatcttctgtttctttgacatctgggtcttactgaccayagagggactgccccttccaggattagccaattcctagagatggtcaacaatttcccagctaccttgcctttcaaatgcaagccaaccaatccagagtccataccctagccatttattttatgggcactctcaccctctgggccactatcccccttccctaatcaccccagaaccaggtataggacaactaaggacagagagcccataaaccccagagcctgctgaaatgatgcaaactagccaatcctaaacctgctttctctgcctcgcccattccttcccgcagaaaccacaagaagg

SEQ ID NO: 82370 - DNA, 601 bp, Human
atttcgaacaagctcccaggtaaagttgatgctgcccatccatggaacacacctagagaagcaaagtcctaggagttcactgcatgctgacagtgtgccactgcaagttcctaggtaagatagctattcacaagctgaatcctcacaactgcaggcatatattctttttatccacattttacaaatgagaccactgggacccaaggtcacccagctggtaaactgctaccagctcaaagccaggtagtctcactcagagaaggaagggtcactctcaaaagcacattctggtcagaacttytcagttgattttctgtcttgaaaattatccttgcctttcctttcacttcctactctctgttcattaaccgtccatttcctatttcaccacctccaagtacatctcccagagaagaactgaggaggtgtggaaccaaatgcccaaactcatccatcccgagcatattaaccatgtgtcttcttttttatcttctgtttctttgacatctgggtcttactgaccatagagggactgccccttccaggattagccaattcctagagatggtcaacaatttcccagctaccttgcctttcaaat

SEQ ID NO: 82371 - DNA, 601 bp, Human
gaaactgtagctcactgtctatcactgcacagaggcaccacatagtacagacaatcaaaacccaggcaattagtatatgcaatgagataccaggttttttagatcatcatccttcttcaaaaaaaaaaaaagaggagggagattgaaagtggtctacataaataagacttattatgtcaacatacatgtgtagatcctactgcaagcaaggcattaaggcaggctggtggagagaaatagatatttgagatatactccatattctcaaggaacacacattctcaggtacagactgtaatgkgcacacaaatcacttgggagtcttggtaaaatgcagattaaaatccagtaggtctgcgtggaacctgagatgctgcatttcgaacaagctcccaggtaaagttgatgctgcccatccatggaacacacctagagaagcaaagtcctaggagttcactgcatgctgacagtgtgccactgcaagttcctaggtaagatagctattcacaagctgaatcctcacaactgcaggcatatattctttttatccacattttacaaatgagaccactgggacccaaggtcacccagctggtaaact

SEQ ID NO: 82372 - DNA, 601 bp, Human
ttacactgggctgaagtgtctctcactgagcctgtgtattctgggaaactgtagctcactgtctatcactgcacagaggcaccacatagtacagacaatcaaaacccaggcaattagtatatgcaatgagataccaggttttttagatcatcatccttcttcaaaaaaaaaaaaagaggagggagattgaaagtggtctacataaataagacttattatgtcaacatacatgtgtagatcctactgcaagcaaggcattaaggcaggctggtggagagaaatagatatttgagatatactycatattctcaaggaacacacattctcaggtacagactgtaatgggcacacaaatcacttgggagtcttggtaaaatgcagattaaaatccagtaggtctgcgtggaacctgagatgctgcatttcgaacaagctcccaggtaaagttgatgctgcccatccatggaacacacctagagaagcaaagtcctaggagttcactgcatgctgacagtgtgccactgcaagttcctaggtaagatagctattcacaagctgaatcctcacaactgcaggcatatattctttttatccacatttt

SEQ ID NO: 82373 - DNA, 601 bp, Human
cctgtgtagggtatgggcattaggaagacacccaatttctatttgtgaatgaaaaatgcaatcattgaatgaatgaagcaatcagtcaagagaggaagaacacacaatggagccacctcctatcagctcaccagagccaatcaaaggcatatcttcccaattctgccttcaataacatcacatcggtagcctgaaattgatcatggtgggattatctttgtcagcatattggcagatgctacaaatcagggctttttcctttttgtcatagagccagtttacactgggctgaagtgtctcwcactgagcctgtgtattctgggaaactgtagctcactgtctatcactgcacagaggcaccacatagtacagacaatcaaaacccaggcaattagtatatgcaatgagataccaggttttttagatcatcatccttcttcaaaaaaaaaaaaagaggagggagattgaaagtggtctacataaataagacttattatgtcaacatacatgtgtagatcctactgcaagcaaggcattaaggcaggctggtggagagaaatagatatttgagatatactccatattctcaaggaacacacat

SEQ ID NO: 82374 - DNA, 601 bp, Human
aatttataaaggaaagaggtttaattgactcacagttctgcatggctgggaggcctcaggaaacttacagtcatggtggatggcaaagggaaagcaagcaccttcttcacaagatggcaggagagagggagcacaagggaaactgacacttttttttgtttgtttgttttttgagacagactctcactctgtcacccaggctggagtgcagtgatgcgatttcagctcactgcaagctccgcctcccgggttcacgccattctcctgcctcagcctcccgaatagctgggactacaggtgyccaccaccacgcctgactaattttttgtatttctagtagagatggggtttcaccgtgttagccaggatggtctcgatctcctgatcttgtgatctgcctgcctcggcctcccaaagtgctgggattacaggcgtaagccaccgcacccggccagaaactgacacttttaaaccatcagatcttgtaagaactccctcactatcaccagaacagcatggggagactgctcccatgattcaatcacctcccaccaggaccctccctcaaaacatggggattgcaattcgagatcagatttgg

SEQ ID NO: 82375 - DNA, 601 bp, Human
gtaatttataaaggaaagaggtttaattgactcacagttctgcatggctgggaggcctcaggaaacttacagtcatggtggatggcaaagggaaagcaagcaccttcttcacaagatggcaggagagagggagcacaagggaaactgacacttttttttgtttgtttgttttttgagacagactctcactctgtcacccaggctggagtgcagtgatgcgatttcagctcactgcaagctccgcctcccgggttcacgccattctcctgcctcagcctcccgaatagctgggactacaggygcccaccaccacgcctgactaattttttgtatttctagtagagatggggtttcaccgtgttagccaggatggtctcgatctcctgatcttgtgatctgcctgcctcggcctcccaaagtgctgggattacaggcgtaagccaccgcacccggccagaaactgacacttttaaaccatcagatcttgtaagaactccctcactatcaccagaacagcatggggagactgctcccatgattcaatcacctcccaccaggaccctccctcaaaacatggggattgcaattcgagatcagattt

SEQ ID NO: 82376 - DNA, 601 bp, Human
cgttttcacactgctataaagaactacttgagactgggtaatttataaaggaaagaggtttaattgactcacagttctgcatggctgggaggcctcaggaaacttacagtcatggtggatggcaaagggaaagcaagcaccttcttcacaagatggcaggagagagggagcacaagggaaactgacacttttttttgtttgtttgttttttgagacagactctcactctgtcacccaggctggagtgcagtgatgcgatttcagctcactgcaagctccgcctcccgggttcacgccattstcctgcctcagcctcccgaatagctgggactacaggtgcccaccaccacgcctgactaattttttgtatttctagtagagatggggtttcaccgtgttagccaggatggtctcgatctcctgatcttgtgatctgcctgcctcggcctcccaaagtgctgggattacaggcgtaagccaccgcacccggccagaaactgacacttttaaaccatcagatcttgtaagaactccctcactatcaccagaacagcatggggagactgctcccatgattcaatcacctcccaccaggaccctc

SEQ ID NO: 82377 - DNA, 601 bp, Human
ttgggagaatgaaacttgacatccccagtgagatgggatgccacatctttttattggtgtcattttttttttttttgagatggggtcttgctttgtcgcccaagctggagtgcagtggtgggatctcagctcactgcaacctctgcctcccgggttcaaacggttctcctgcctcagcctcccaaatagctgggactacaggcatgcaacaccacacatggctaatttttaaatttttagtggaaatggagttttgccatgtcggccaggttggtctcgaactcctgacctcaagtgatcygcctgcctcggcctcccaaagtgctggaattacaggcgtgagccaccgcgcctggcctattggtgtcatttataagtacccatagcttccaatcaattctcaaagggtccaggggcccaaataagattacagacattatattcctatattagtccgttttcacactgctataaagaactacttgagactgggtaatttataaaggaaagaggtttaattgactcacagttctgcatggctgggaggcctcaggaaacttacagtcatggtggatggcaaagggaaagcaagcaccttctt

SEQ ID NO: 82378 - DNA, 601 bp, Human
ccagatacacttcctgctgatagacagtgagctacagactcacacacagagtttcccagaacacacaggctcagtcagagacaccttaacccagtatagatatttagagaatgtcttaatctgagacaggcttgggagaatgaaacttgacatccccagtgagatgggatgccacatctttttattggtgtcattttttttttttttgagatggggtcttgctttgtcgcccaagctggagtgcagtggtgggatctcagctcactgcaacctctgcctcccgggttcaaacggttctccygcctcagcctcccaaatagctgggactacaggcatgcaacaccacacatggctaatttttaaatttttagtggaaatggagttttgccatgtcggccaggttggtctcgaactcctgacctcaagtgatctgcctgcctcggcctcccaaagtgctggaattacaggcgtgagccaccgcgcctggcctattggtgtcatttataagtacccatagcttccaatcaattctcaaagggtccaggggcccaaataagattacagacattatattcctatattagtccgttttcacactgct

SEQ ID NO: 82379 - DNA, 601 bp, Human
atacaaaactgtatgcatagggtgatctcatttggattaaatatgttcatatatacatatatatatatatacacacacacacacacacacacacacacaattatgtatttcaataaaggatacctccaacagtaattaaggatacctccaacagtaataacagatggagaatgggattggttggaagggtaggacaagataaacaactttcactttttaaagcttacacattcctgcatgatttgaacatttaacactaaacctgtatagttatataatgataatttttaacaaaaaaaawtttttaaaaaagtaaacaacttaccaaccagatacacttcctgctgatagacagtgagctacagactcacacacagagtttcccagaacacacaggctcagtcagagacaccttaacccagtatagatatttagagaatgtcttaatctgagacaggcttgggagaatgaaacttgacatccccagtgagatgggatgccacatctttttattggtgtcattttttttttttttgagatggggtcttgctttgtcgcccaagctggagtgcagtggtgggatctcagctcactgcaacct

SEQ ID NO: 82380 - DNA, 601 bp, Human
tattatgcaaccattaaaagaatgagatagatctatgtatacctaaaacataatgcttaagttggaaaaaaaatacaaaactgtatgcatagggtgatctcatttggattaaatatgttcatatatacatatatatatatatacacacacacacacacacacacacacacaattatgtatttcaataaaggatacctccaacagtaattaaggatacctccaacagtaataacagatggagaatgggattggttggaagggtaggacaagataaacaactttcactttttaaagcttacayattcctgcatgatttgaacatttaacactaaacctgtatagttatataatgataatttttaacaaaaaaaaatttttaaaaaagtaaacaacttaccaaccagatacacttcctgctgatagacagtgagctacagactcacacacagagtttcccagaacacacaggctcagtcagagacaccttaacccagtatagatatttagagaatgtcttaatctgagacaggcttgggagaatgaaacttgacatccccagtgagatgggatgccacatctttttattggtgtcatttttttt

SEQ ID NO: 82381 - DNA, 601 bp, Human
gagccctatgttttcgaaggcagggctgctgtaatataagggtgatccatcaaatagaccactatggatgatttattgcatacctctgaaagactttctatataatgaaacgtgccagacattagtacaaacgatattatgcaaccattaaaagaatgagatagatctatgtatacctaaaacataatgcttaagttggaaaaaaaatacaaaactgtatgcatagggtgatctcatttggattaaatatgttcatatatacatatatatatatatacacacacacacacacacacacacccacaattatgtatttcaataaaggatacctccaacagtaattaaggatacctccaacagtaataacagatggagaatgggattggttggaagggtaggacaagataaacaactttcactttttaaagcttacacattcctgcatgatttgaacatttaacactaaacctgtatagttatataatgataatttttaacaaaaaaaaatttttaaaaaagtaaacaacttaccaaccagatacacttcctgctgatagacagtgagctacagactcacacacagagtttcccagaacacaca

SEQ ID NO: 82382 - DNA, 601 bp, Human
tcttaaacgtggatcccttgactttacattttgagcttattccaggccatcatgcacactttcctacacattctcctgcattcattttcaatctcatgttctccctctctccctctctcacagaatctgagtccagggaccacggttaaggtgtaattacagtgagagtgagccctatgttttcgaaggcagggctgctgtaatataagggtgatccatcaaatagaccactatggatgatttattgcatacctctgaaagactttctatataatgaaacgtgccagacattagtacaaaygatattatgcaaccattaaaagaatgagatagatctatgtatacctaaaacataatgcttaagttggaaaaaaaatacaaaactgtatgcatagggtgatctcatttggattaaatatgttcatatatacatatatatatatatacacacacacacacacacacacacacacaattatgtatttcaataaaggatacctccaacagtaattaaggatacctccaacagtaataacagatggagaatgggattggttggaagggtaggacaagataaacaactttcactttttaaagctta

SEQ ID NO: 82383 - DNA, 601 bp, Human
gctggctgtgtgtatatgagccacctccttctgccccaggctcccacctccctgagactctgcccaacctctctgcatcccaggacttccaacacagaaggaagcttttaatggtctggtctactcttgttttacagaaaagaggaaagcccacccaaaaaagaacttgcccaagctcacctagccagttaatgtgagagccggggctaatcccagctctcctaatgttcaggttcatgactctggggtatgcccctgacctcacccccactgaccacccaccccactcccaggacttagycaccttttggatagagtaggggcctgtggagggaccagcctggccacagcaaagacaaggaaaaaatttaatggggagaggaaaacacagagatccacacagccaggaagtatgtagctagatcttaaacgtggatcccttgactttacattttgagcttattccaggccatcatgcacactttcctacacattctcctgcattcattttcaatctcatgttctccctctctccctctctcacagaatctgagtccagggaccacggttaaggtgtaattacagtgagagtgagccctat

SEQ ID NO: 82384 - DNA, 601 bp, Human
tgagacttgagaacttaagtagcttggcagggtttaaaccaggaagtgtctggctccagaatctaaattcatcacaacttaataacactgtcctctgagggcttaatctgtgcaatgcctgacacggaggtagcatttatgatccattctgcagaaggaaggcaaggaattcaaaggtggaaaggacttgccacttcttctccagggctggctgtgtgtatatgagccacctccttctgccccaggctcccacctccctgagactctgcccaacctctctgcatcccaggacttccaacasagaaggaagcttttaatggtctggtctactcttgttttacagaaaagaggaaagcccacccaaaaaagaacttgcccaagctcacctagccagttaatgtgagagccggggctaatcccagctctcctaatgttcaggttcatgactctggggtatgcccctgacctcacccccactgaccacccaccccactcccaggacttagccaccttttggatagagtaggggcctgtggagggaccagcctggccacagcaaagacaaggaaaaaatttaatggggagaggaaaacacagagat

SEQ ID NO: 82385 - DNA, 601 bp, Human
cacactcaggaactttggcctacagaccaccctctgtagcaggcacctgcttttcaccaggcccatagtaattctgattcagggagtgggcagattacaatttgagagaaacagaggctcagaaggaccctgaaggtcgttccagcaataggattctgtggccacttccctcccttcctccaactgctgttcctggttatttgcccatgtcacgactgcaatcctctcagacggcctggggatggaggagaggctggcacaagccccagcactgtcagtggactgcagctttgttgctggsggaatgtctgagaatgtggttccaggggctgtccccgccctcaaccctaattcctttagctgccctcttccaagcaccaccagttgtttatccttctaggagccttggttgatctaatttgctgaatgttagccctggcaaaggcagaactcagccagaaggcatgagctggggcccaggaggctgggtggccagcctcacatgccattctccattctgttctccatcctattgctcatcgttaagagatggatacaaatgaaattgtataggaaaacccgggcaggccaggccaggcag

SEQ ID NO: 82386 - DNA, 601 bp, Human
cagtgggaggaggaagcccaggagtaagccccatggactctagcagcattttgtatgctctaaaacctcaggcaggctctcatccatgcagagagctcagaacctacagcatctccaacccagtctttgccactgtaaattggcaggacctctctcttagcttatctcagcttccacctccaccacaaccgccacttgggattcctgcccagattttgccctttgggaagagcctgtgatgctctctggaaaatcagcgccaggctctgatgggcagcagcctttcccggatcccatccctggctgacctcattccagatccaggaagcctgatgacttcctggttgcctcacccagtctgacgcagcagtacccaatcaccccctctgacggacatctaaggtactccctgaacatctgggggtgggagcgtggcaaggagcaagggtcgcatccactccctaatccagccaggaaagggcagaggagagagctgctgcacgcatcctgttcccaagttatcttttcatctcagccaaccaaggcctctcccatcacctcagtttcccctaacggctacacactttgggaacacagaggg

SEQ ID NO: 82387 - DNA, 601 bp, Human
accaaggcttctgagggcttttctagcctcagcaagaaagaggaccatgacttattatcaattgctattgctaatgatcagtgaaggcccaggcagcagatatctgccaaccttgatacaatgagataaacatgattgtaaaggtatgtaatcaaggctcagtgggaggaggaagcccaggagtaagccccatggactctagcagcattttgtatgctctaaaacctcaggcaggctctcatccatgcagagagctcagaacctacagcatctccaacccagtctttgccactgtaaattsgcaggacctctctcttagcttatctcagcttccacctccaccacaaccgccacttgggattcctgcccagattttgccctttgggaagagcctgtgatgctctctggaaaatcagcgccaggctctgatgggcagcagcctttcccggatcccatccctggctgacctcattccagatccaggaagcctgatgacttcctggttgcctcacccagtctgacgcagcagtacccaatcaccccctctgacggacatctaaggtactccctgaacatctgggggtgggagcgtggcaaggag

SEQ ID NO: 82388 - DNA, 601 bp, Human
tagcgaacaagacacaccaagtgcctacccttgtgaagcgttgagtgtaaacattggaataagtcactctaatgtataacagagagagcaaaaagtttcatcaccccttggactggaggcagctgcttcaactgttacatcaccaaggcttctgagggcttttctagcctcagcaagaaagaggaccatgacttattatcaattgctattgctaatgatcagtgaaggcccaggcagcagatatctgccaaccttgatacaatgagataaacatgattgtaaaggtatgtaatcaaggctyagtgggaggaggaagcccaggagtaagccccatggactctagcagcattttgtatgctctaaaacctcaggcaggctctcatccatgcagagagctcagaacctacagcatctccaacccagtctttgccactgtaaattggcaggacctctctcttagcttatctcagcttccacctccaccacaaccgccacttgggattcctgcccagattttgccctttgggaagagcctgtgatgctctctggaaaatcagcgccaggctctgatgggcagcagcctttcccggatcccatccct

SEQ ID NO: 82389 - DNA, 601 bp, Human
ttttgtcattcggcactagagatgttcttggctgtggtggccatcactcatataacaccttccactgccatttggttattgctggaggctgctctgggaccctggattcagtcctttattctcagaaaatactgagatgagctgatgagcacaggcaggacagaggccagcatatgagagggagtgtgctaaccaccacgttcccacagaacctcgaaacctcgaaacaccatgccattttcagtatgaatcaatatgaggactgtgtgcatatggtgtagtgtctactccaatagggaargcatactttttttccccactttttaatttttatttatttttctgaggcagggtctcgctctgtcacccaggcttccgggttcaagtgattcccgtgccccagcctcccaaagtagttgggactacaggcacccagccatcatgcccagctaatttttgtacttttagtagagatggggtttcgccatgttgcccaggctggactcaaactcctggcctcaagcaatctgcctgctttagcctcccaaagtgctgggattataggcatgagccatggcgcccagccttcttttcacttttt

SEQ ID NO: 82390 - DNA, 601 bp, Human
acagagctgctggataagcagcagctacctccgtaatgattttgtcattcggcactagagatgttcttggctgtggtggccatcactcatataacaccttccactgccatttggttattgctggaggctgctctgggaccctggattcagtcctttattctcagaaaatactgagatgagctgatgagcacaggcaggacagaggccagcatatgagagggagtgtgctaaccaccacgttcccacagaacctcgaaacctcgaaacaccatgccattttcagtatgaatcaatatgaggrctgtgtgcatatggtgtagtgtctactccaatagggaaagcatactttttttccccactttttaatttttatttatttttctgaggcagggtctcgctctgtcacccaggcttccgggttcaagtgattcccgtgccccagcctcccaaagtagttgggactacaggcacccagccatcatgcccagctaatttttgtacttttagtagagatggggtttcgccatgttgcccaggctggactcaaactcctggcctcaagcaatctgcctgctttagcctcccaaagtgctgggattat

SEQ ID NO: 82391 - DNA, 601 bp, Human
atttccccaaagcagtctggagcctggaatggaagctatcaagagagcagtttttctgcaagacccattgcctcccccttacctctaaataatcagccacgaggtaaagctccacatacttcatggagtttaaatcttcccttttcatctaagaaagagaaacagatcagcgctgtagaaatagtggacttggcctcatttttaaaaaactgctaagaaacagagctgctggataagcagcagctacctccgtaatgattttgtcattcggcactagagatgttcttggctgtggtggccrtcactcatataacaccttccactgccatttggttattgctggaggctgctctgggaccctggattcagtcctttattctcagaaaatactgagatgagctgatgagcacaggcaggacagaggccagcatatgagagggagtgtgctaaccaccacgttcccacagaacctcgaaacctcgaaacaccatgccattttcagtatgaatcaatatgaggactgtgtgcatatggtgtagtgtctactccaatagggaaagcatactttttttccccactttttaatttttatttatttttc

SEQ ID NO: 82392 - DNA, 601 bp, Human
atactgtagttggagaagttccccccaactatgtttaaaatggcaaaatgagcctttggtcagattttttttctttgagacggagtttcgctcttgttgctcaggctggagtgcagtggcatgatctcagctcactgcaacctccgcctcccaggttcaggaaatgctactgccacagcctcccaagtagctgggattacaggcatgtgccaccatgcccagctaattttgtatttttagtagagatggggtttcaccatgttggccaggctggtctcaaactcctgacctcaggtgatcyacccgccttgcccacccaaagtgctgggattacaggcgtgagccgccgcgcccagcctttggtgagatttaaggtcaaaatcatagatgaactggagaaagatgaatgggcaacatttccccaaagcagtctggagcctggaatggaagctatcaagagagcagtttttctgcaagacccattgcctcccccttacctctaaataatcagccacgaggtaaagctccacatacttcatggagtttaaatcttcccttttcatctaagaaagagaaacagatcagcgctgtagaaatagtg

SEQ ID NO: 82393 - DNA, 601 bp, Human
catcctatagacacactagtctttggagaggaaacagaaaacatagagcacacacacacacacacacacacaaacagctgttggaaaaaccaatatcaacatcagttaaaataaatctaaacgcttttcaaagcagagcacaatgttccctcggcccggaatgcccttcacctccactcctctgcccagttaactcctccttgtcttttaagacagcttcaagggccacctccttctgctgctaacatccagtgactaacactcaaagaccttctggcctgcagcctagtgctctccccamcaccaggccctgctgccaggacacatgctttggaaatgtgactaggtacagctgccttagaatgagctctttgggaagatggtagctaaactatgtggatgggatacagacagactggagttgtgatgggctctatcctcaggagagaccaaggccagtgtctgccctgctcgaacacagcgagcgctcagctcataatgacatccaatgcacagaagatgcacttagtacttatatgatggagtcactaaacaaagtgagaattggaggtaacatctggctaatttaggcaaatatggg

SEQ ID NO: 82394 - DNA, 601 bp, Human
cccaatgagaccaccataatttaaggagcgaattctgttgtccagagtattctgaagcaggagtcagcaaatcttttctgcaaaggccggattaggctttgcggccccatagtctctgctacaactcttcaactgtgcagtggtggctcagaataatacagacacctgtatatataatacagaagcctggataatacagaaaccaatgggcctggctgtgttccagtaaaattttgtttgcaaaaacacaggataggctggatgtgaccatggggtatagtttgcagacccctgatgtaamgaaaggactgtctcaaacttacattttctagggtgacacagtgagtaccacatgcagcaccatcctttcccagccactctgcactgtgccagcatcatggaagtcctttacaggcctgtgtttacagttatcctgtctactcctacaacagcccaccttactctttatccccacctggattccgttccacctggggaatgaataaactgagaaccaccctagaagctcccacctaggcccagggagcgaggagctgcctgctcatttttactgctgacaactctctctctaggcagcagc

SEQ ID NO: 82395 - DNA, 601 bp, Human
agcaagaaagaacaagaacagccaagtaaaacaacctggggtatttgtttggccagaggtgtgtaccagccctgatacagggaagaaatccaccatttccctttcaccacagcttgtggacattcttaggcttccttaaaactgccactcaccagaagagaatctgttaccactgctttctagagttagattcagtgtgacactgtaacttagacctttccaaggtgttaatccaggagtttctcattatagaggcctcctgtttctaaattggtctctcggcacagacagcgttgcagcrtttccattcatttagtaatatttattagaacatcagggccagatttcattgtctttcaaaaaaatattaatcttctcttcaaagaactgcccaatgagaccaccataatttaaggagcgaattctgttgtccagagtattctgaagcaggagtcagcaaatcttttctgcaaaggccggattaggctttgcggccccatagtctctgctacaactcttcaactgtgcagtggtggctcagaataatacagacacctgtatatataatacagaagcctggataatacagaaaccaatgggc

SEQ ID NO: 82396 - DNA, 601 bp, Human
ttacaacctccgcctcccgggttcaagcgattctcctgcctcagcctcctgagtagctgggattacaggtgctcgccaccatggccagctaatttttgtatttttagtaatgatggggtttcaccatgttggtcaggcttgtctcaaactcctgacctcaagtgatccatctgccttggcctcccaaagtgctgggattacaggcgtgagccactgcgcctggccgtaatcagacatttctaaccaagcacaggaaagaaagctgtgttccattagaaatatctgccatgggtaccagaaagaggacattttagtatgaatacctcctatttaccattcctgcctcaaaaagatagatctctctgagctgcaatgatgaaggaaagcttcacagtgtaaagagaaaacctgctacaactgcaaattacatttaaaaatgatgggcatgtcctgtacactgccattgttacacagaatctgggtcctctctaatttatcttaggtacccactatacatgttattttgattcaaaatcttcacgtccttcctccaccccatcccatgagaatatctaagcaagaaagaacaagaacagccaag

SEQ ID NO: 82397 - DNA, 601 bp, Human
cctagaggagcttcaattaaaacagagagggccagaaataactgtggcagatgctgagtgacagaccctgtacttaaggagtatagaactgaaatggttgagaaaacctgccgggaaaacgtgcacagaaataaccacagtgggaggtcatgtgaatgacatgagtgccaacgaggaggaccataagacactggcaaataggcttcatcttgcacaccactcagatccactggcagtgccttctacagtgagaagaatgagaagaattatgagactgcatcgattcaatcacatttctttyttttttttttttttttgagacagagtctcgctcttgttgcccaggctggagtgcagtggcgtgatctcggcttacaacctccgcctcccgggttcaagcgattctcctgcctcagcctcctgagtagctgggattacaggtgctcgccaccatggccagctaatttttgtatttttagtaatgatggggtttcaccatgttggtcaggcttgtctcaaactcctgacctcaagtgatccatctgccttggcctcccaaagtgctgggattacaggcgtgagccactgcgcctggccgtaa

SEQ ID NO: 82398 - DNA, 601 bp, Human
tattctgcattttgtactataacaaatatcttctttcatatacacaatgtacttccaagtcccagaccagcccgttctagtaaaattcaaaaatgtaggtatttccgaagagcatcttgtaaaaggtcctgacctaggaaagttaaccactgcacatccttcctaagagacaagacataattttaggataactttacagatggagactttatagattagccccaagcaacccacttctcagacaatccgcttctcaagcaacccacttctcaaacagcccacttctcaacttttaaggctrtgtgtctttcccaccctgacctacctcaattccctcctaagtcagagaatccctgggctttgtatctggaaggaaccttaaagaaccttaaaggattcttaaactgggctcttccatgccccaagctgctcgggagccactgcaggggtaagaggaaggggtcagaaggacagtgttctgggtcctcaccccagctcccacttagagcagtctgttttcatctaacttttatagtagatattggcataagatttcattttttaaaattccaccaggaaaataaaaataacaaaaaaaaac

SEQ ID NO: 82399 - DNA, 601 bp, Human
atctgactcgacctcctcgaggctagagctacatctaatctttatgatctggcatttttcacctcatacaaatataagcaggaggagggttttctttaaagctaaaccactggaaggtgtggatacaacgggttctttgatgggtccaccctacaaatactgagccagtgacttaataaaaagccccatgtatggagaggacataatgagcaggagataccatctttatccaaaattggtaggtactgccccagctgaaaagaataatcatagcaccaacatttttccaccactttttacrtactaggcactgaggcttagagaagttaaggaacttgcccaaagtctcagcaagaagatggtggagccaggatgaaggcccaaattacaacctcagagcctatttgtgaccctttactacttcagtgctgcagtacctacacatccagataatccactcgctccaagaaacgctggtcaagatgggctccagattcagtgaaatatcagtttatttcaacagaaattttgatttttctgttttgtgccagttcaatcgttacagaaaataaaaggttcagattccaatttgaatttgctt

SEQ ID NO: 82400 - DNA, 601 bp, Human
aaaaaaaataaaaataaaataaagccatcgccatcatccagtgttagaatattttcatcacatcggtgagatccctcatgtctattgatagtcatttcccattctcaccctcagcccaggcaaccgtgcatctactttgtttctattctgccttttctggacatttgttttacaatatgtggttttgtgtgtctggcttctctcacttaccataatgtttttgagatgtatccatgtgttagagtgtattcgtttatgatttctctttattgctgaataatattctttcgtatggatatamcaaattatattaatacatggatattttattataaaatgtctcccactcattttggaagtaaatgagtataaatgacataaaagtgcacagatatgcttactcttcaaattttcttccccatccctggatagtctcaggttttgtcaaggatggaataagcaggttgcaagcaatagactacagacgttcttggtaatcttcagggttttgtccaaaccagagatcctgaaattctatacccaagatctgactcgacctcctcgaggctagagctacatctaatctttatgatctggcatt

SEQ ID NO: 82401 - DNA, 601 bp, Human
cactctgggaggctaaggtggatggatcacatgaggtcgggagttcgagaccagcctgaccaacatggagaaaccccatctctactaaaaatacaaaattagctgggcgtggtggcgcatgcctgtaatcccagctactcaggaggctgaggcaggagaatcacttgaacccgggaggcaggggttgcggtgagccaagattgtgccattgcactccagcctgggccacgggcgaaactccgtctcaaaaaaaaataaaaataaaataaagccatcgccatcatccagtgttagaatattytcatcacatcggtgagatccctcatgtctattgatagtcatttcccattctcaccctcagcccaggcaaccgtgcatctactttgtttctattctgccttttctggacatttgttttacaatatgtggttttgtgtgtctggcttctctcacttaccataatgtttttgagatgtatccatgtgttagagtgtattcgtttatgatttctctttattgctgaataatattctttcgtatggatataccaaattatattaatacatggatattttattataaaatgtctcccactcatttt

SEQ ID NO: 82402 - DNA, 601 bp, Human
gagccttatctttcttatgggtatctaaaaagttctcttgtatatagattttttaaagccacttcattgaggtataatttgcataccataatacccatctattttaagtgtacagctcaatgctttttggtaaatttaccaagttttaaagccatcaccagccaagcgtggtggctcacacctgtaatcccagcactctgggaggctaaggtggatggatcacatgaggtcgggagttcgagaccagcctgaccaacatggagaaaccccatctctactaaaaatacaaaattagctgggygtggtggcgcatgcctgtaatcccagctactcaggaggctgaggcaggagaatcacttgaacccgggaggcaggggttgcggtgagccaagattgtgccattgcactccagcctgggccacgggcgaaactccgtctcaaaaaaaaataaaaataaaataaagccatcgccatcatccagtgttagaatattttcatcacatcggtgagatccctcatgtctattgatagtcatttcccattctcaccctcagcccaggcaaccgtgcatctactttgtttctattctgccttttctgga

SEQ ID NO: 82403 - DNA, 601 bp, Human
aaaagttgttctgcatgatgttcaagtagggcttaggtcaataggtaaaacagacaggaacataaatttcattttaaaataggaagaaggctttcaaacaaagctggtcatgagatagctcagagctgagctttgctgtcttctgtaatcagtgcccttggccaggctgtctggtacaatttttttctcccaattccttatgtgagccttatctttcttatgggtatctaaaaagttctcttgtatatagattttttaaagccacttcattgaggtataatttgcataccataatacccayctattttaagtgtacagctcaatgctttttggtaaatttaccaagttttaaagccatcaccagccaagcgtggtggctcacacctgtaatcccagcactctgggaggctaaggtggatggatcacatgaggtcgggagttcgagaccagcctgaccaacatggagaaaccccatctctactaaaaatacaaaattagctgggcgtggtggcgcatgcctgtaatcccagctactcaggaggctgaggcaggagaatcacttgaacccgggaggcaggggttgcggtgagccaagattgtg

SEQ ID NO: 82404 - DNA, 601 bp, Human
ggacattctggtggcagaactgcagtgactttgtttagagatgactgagataggacataaaattgctttcagatatgaataggtctatcatgtggaaaaagttgttctgcatgatgttcaagtagggcttaggtcaataggtaaaacagacaggaacataaatttcattttaaaataggaagaaggctttcaaacaaagctggtcatgagatagctcagagctgagctttgctgtcttctgtaatcagtgcccttggccaggctgtctggtacaatttttttctcccaattccttatgtgrgccttatctttcttatgggtatctaaaaagttctcttgtatatagattttttaaagccacttcattgaggtataatttgcataccataatacccatctattttaagtgtacagctcaatgctttttggtaaatttaccaagttttaaagccatcaccagccaagcgtggtggctcacacctgtaatcccagcactctgggaggctaaggtggatggatcacatgaggtcgggagttcgagaccagcctgaccaacatggagaaaccccatctctactaaaaatacaaaattagctgggcg

SEQ ID NO: 82405 - DNA, 601 bp, Human
atcggtaaaactgaaaggacacagaaaaaccacagtatctgtcaataccacctgggatttaaaagccccttcctttcattctggtggagcttgagattaaaaagaaaaaaactaaaactaaaaaataaaaataaatttaaaaaaaaagctccttcctagcctaagaactcagagcacagataccagatttctcttctgcccatggctccaacagaaggaggcaactggtgttactgacattttttagaaagggaaaatgagatcctgagagagagcaggacattctggtggcagaactgcrgtgactttgtttagagatgactgagataggacataaaattgctttcagatatgaataggtctatcatgtggaaaaagttgttctgcatgatgttcaagtagggcttaggtcaataggtaaaacagacaggaacataaatttcattttaaaataggaagaaggctttcaaacaaagctggtcatgagatagctcagagctgagctttgctgtcttctgtaatcagtgcccttggccaggctgtctggtacaatttttttctcccaattccttatgtgagccttatctttcttatgggtatc

SEQ ID NO: 82406 - DNA, 601 bp, Human
acttccaagcccacgagagcaatccggatgttcaaggatcggtaaaactgaaaggacacagaaaaaccacagtatctgtcaataccacctgggatttaaaagccccttcctttcattctggtggagcttgagattaaaaagaaaaaaactaaaactaaaaaataaaaataaatttaaaaaaaaagctccttcctagcctaagaactcagagcacagataccagatttctcttctgcccatggctccaacagaaggaggcaactggtgttactgacattttttagaaagggaaaatgagatyctgagagagagcaggacattctggtggcagaactgcagtgactttgtttagagatgactgagataggacataaaattgctttcagatatgaataggtctatcatgtggaaaaagttgttctgcatgatgttcaagtagggcttaggtcaataggtaaaacagacaggaacataaatttcattttaaaataggaagaaggctttcaaacaaagctggtcatgagatagctcagagctgagctttgctgtcttctgtaatcagtgcccttggccaggctgtctggtacaatttttttctccc

SEQ ID NO: 82407 - DNA, 601 bp, Human
aaaagaaaaaaaaaaaagaaaagaagacaaatggttttattatctatatgccttttgttgtaactgcctcaaaataccttcagaagtcaacactaataaataccaaataatcaccctggggcactgtcacatgtgacccccatcactgtctctcccaggctgatgaaaatctagcacaatccctcctcaatgtctccctccaaccaaaccctcagttcctgcactgtctaacacttggactctctcaagcactcagccttgtgccccttgggaaccaagtgaaggacaacacaaggagccygctctcctgtgcctgtgttgggagatcagctcatgtattagaacaaagcgccaggaagattgagatgagtctcttagaaagtctaagacctgaccaacagtcagtcccttcccaaatacatacacaattatttcagatgctcaatggaatatgtgtaagtctaattttcccattagactgtaaacatttcttaggaataatgtgactcaggcttttaaacattttctggggtatgctgggtacagagcgcatgtttaggaaatgcctgattctctggaccagggagtcagaatggccttg

SEQ ID NO: 82408 - DNA, 601 bp, Human
cccaggttttggggacagttatttttcccagtttctttaaaaggataagccaaagtttaaatgattattaactcagctatatttagggaacagaagaaaaatggtttgaaggccaggcatgtgtggctcacgcctataatcccagcattttgggaggccgaggcgggcggatcacttgaggccaggagttcaagaccagcttggccaacatggcaaaatcctgtctctattaaaaatacaaaaattggccgggcatggtggtgcatgcctgctacttgggaggctgaggcactagaattgyttgagcccaggaggcagaggttgcagtgagccgagatcacgctactgcactccagcctaggtgacagacggaaactgtctcaaaaaagaaaaaaaaaaaagaaaagaagacaaatggttttattatctatatgccttttgttgtaactgcctcaaaataccttcagaagtcaacactaataaataccaaataatcaccctggggcactgtcacatgtgacccccatcactgtctctcccaggctgatgaaaatctagcacaatccctcctcaatgtctccctccaaccaaaccctcagtt

SEQ ID NO: 82409 - DNA, 601 bp, Human
ctgtctgatgatgcaaaagctaaagaaatcaagaggaaaaaaacccagcaggaaagaagcagcagaaagagatttactaaacatggaagtgtgtttcctgcattatttcatttaattcccattcctatcctatgattatcaactgtaaaactatgcgttttttacagctgagaacactcattaactcacccaaaatcacacagctgttctttgaacccaacaggctcagaccctagagcctgtggttttggccattatgctactttgtcgataaatacagaatggatagagggacagacamatagatgaagacaagtcttccttgatatgcacttcacaggttagaaatgaagagtcaaaacaaatagtctcatgaagtcagagtgaatttcaaaagaaggcagtaatttcctaaccatgactttgagacaggttcttgtttcttaatgacatatataacagcacacgacctgaaataaaaatacttttaacctctactctcttactattttccagcccctggtttggaacatatgagatctagtgatgtatgcatgtaatctcttcagggttcctgagcttgaagatacggaatgaacta

SEQ ID NO: 82410 - DNA, 601 bp, Human
cagctgccatgatgcacccaccatcagccgcactggccgagcagcaatctgcagaatcatgggtcatgccaaagttgtggcccatctcgtgggccatggtggcagccacgccaatggcattctcggagtggtcctgctcagaagacagagttgaggtcaaggtcaaggggacagatctgcctctgccccccatccctgccttatccttagccaagtcttgcaggtctccaccaattccactgtcactgagcatacagactctccatatgtgcctctgacagcaaggctgaatctgctgtcwctaggaggaaatcaaatgtttaaaagtccatgtttcctgagttctcaaaggttgcagaccacaactgacctatggatgaacttccagaccaataaatgctttcagaataaataaaagaggaagatttttccccattcttcttctgaacatatatatttctccagacataaggaaatcaacatagaaaacacgaccttgattcaaacatagggtgtacttggcttagtgtttcctgagaaaaccacacaagacagatacactccaggcacagcacttggtgtactgtctgatgatgcaaaa

SEQ ID NO: 82411 - DNA, 601 bp, Human
ctccctcttgctgtttgactcacccagtggcagctgccatgatgcacccaccatcagccgcactggccgagcagcaatctgcagaatcatgggtcatgccaaagttgtggcccatctcgtgggccatggtggcagccacgccaatggcattctcggagtggtcctgctcagaagacagagttgaggtcaaggtcaaggggacagatctgcctctgccccccatccctgccttatccttagccaagtcttgcaggtctccaccaattccactgtcactgagcatacagactctccatatgtscctctgacagcaaggctgaatctgctgtcactaggaggaaatcaaatgtttaaaagtccatgtttcctgagttctcaaaggttgcagaccacaactgacctatggatgaacttccagaccaataaatgctttcagaataaataaaagaggaagatttttccccattcttcttctgaacatatatatttctccagacataaggaaatcaacatagaaaacacgaccttgattcaaacatagggtgtacttggcttagtgtttcctgagaaaaccacacaagacagatacactccaggcaca

SEQ ID NO: 82412 - DNA, 601 bp, Human
agaacttaaagtataaaaaaaaaaaaaagaattctttcatccttagtgatgagatattaaccaccccataacattctatttttcttagtcggcatgcagaaagcatttgagaatcaggagtagcaatttctgcccattgcatgagggggctgcgataagtaaagggttgtgagtgtgttacaagaggtctcctgagacttagcactgaagaaaacaccagccaacctaaacttttcctgaagctgatatcaggtgaatattctcttgtgacagaggaccaggccaaaaaaaggccaagatsataagttttatttcattttgggccagtgatctcattgctgttctaaggatgcagagggcattccaaactcaaccagccaactcataaacgcatgctctttatcacaggagtatggaaggtcctgggtcccaccattggtgaaaaggacaaatagtacagccatctgggtctacaaaaggagagttatcctgctcccaattctctaaaccaattaaaggttaaaccctccaagaaactggagcttttccttcagtgggaaggtatgctccaaggaatttgttactaataattgttaaacta

SEQ ID NO: 82413 - DNA, 601 bp, Human
ccattgtctcacacacatacattctggccccttagaacatttaccaatacattaatttagaattttttcatcccttgagttcgtgtccttagtagggacatggatgaagctggaaaccatcattctcagcaaactattgcaaggacagaaaaccaaacaccggatgttctcactcataggtgggaactgaacaatgagaacacttggacacaggaaggggaacataacacaccggggcctgttgtagggtagcaagaggcggggagggatagcattaggagatatacctaatgtaaatgaygagttaatgggtgcagcacaccaacatggcacatgtatacatatgtaacaaacctgcacgttgtgcacatgtatcctagaacttaaagtataaaaaaaaaaaaaagaattctttcatccttagtgatgagatattaaccaccccataacattctatttttcttagtcggcatgcagaaagcatttgagaatcaggagtagcaatttctgcccattgcatgagggggctgcgataagtaaagggttgtgagtgtgttacaagaggtctcctgagacttagcactgaagaaaacaccagcca

SEQ ID NO: 82414 - DNA, 601 bp, Human
gtagcccacactcagtgtgcctgttgaatgagcaactgctcagaacctaagccaactggccatgcccactctcaggccattcctcaaccccagtggccctccatgttcataccactccctcctttctgatgggtctgtgttgatctctctgggctcatggtggtgggggtggcatccttgactagttcttgttttattctgaaagtgacatactggcattaaaaaaagaaaaatcacatcacagaggtcacaggcagggtgcggtggctcacgcctgcaatcctagtgctttgggaggccraggtgggtggatcatctgaggtcaggagtttgagaacagcctggtcaatgtagcaaaactctgtctctgctaaaagtacaaaaaaaaaaaaattaaccaggtgtggtggcacacacctgtattcccagctactcaggaggctgaggcaggagaatcgcttgaaccctggaggtggaggttgcagtgagtggagatcttgtcactgcactccagcctgggcaacagagtgagagagagaaggccataaaatcagatttttttttccatttatacagaacctcagtctcacccccataattt

SEQ ID NO: 82415 - DNA, 601 bp, Human
agctggattcagtcccttcctgactgcctgattccagataaacctcttatcccctataagctctagtttccacatcttaaaataaggatagtcacatatattttatggggtttttgtgaggagagaatgagataacgtacataaaattcccagcacagtgcctggcatctactaagaggtccattaatgtcaatacaaatgatgataattattattgtttatgagctcaataaaatcaagcccactctctctggatacttctttaaaaaagaaaaaaaaaagtaccatttccaaagaagcrccaccctcctctgggatgatctgaattcagtgaggcccagtataggaatagtaaattttattcaaggcaccttttccgctctgtgtttctgaaactctgttgccatcacagccccaggatggaggcaaatccccagccatccaccccagcagagcagtcctgtggtcccactgtcaggccagggcccaaggcgtggagaaaagggccacttaccttacactggtggcagcaggagccgtgagcacactccgcccccggcctcagggtacaattagaggcattgcagcaggggttgttaca

SEQ ID NO: 82416 - DNA, 601 bp, Human
aaatgctaactcactttctcttcatagaagtcttaagaaagaggcaagaaataatacctatacaacaatttacagtttcctacatgctttagtaatagcagctacttttatgcagctcccacttaagtgtccagtacaaatatgacttcacttagttttcatgacagtcctgtgtgatataattatcccttctgcagatgataaaatctgtaggcttaaagaggttagacgatgcatccaaagactcatagtaagtggcagaggagccaggcccactaatacacacacacacacacacactcacacacaaaactagcattcacataacatctgtgagtttacaaagcacctcagcaataatatatccccactatggggccaggcactgggctgagtgtgtgacatacacgtatctcgtgggatcctcacagcttccatgggatagatactgctatttgtcccactttgcagatcaataagttgatcaacagcacacctggggcaaagggcgaagagtcttacagcctccctgggtagtcggtgttactaatactctttccattttacagataaagaacctaggctcagagagttaataggt

SEQ ID NO: 82417 - DNA, 601 bp, Human
caaatgctaactcactttctcttcatagaagtcttaagaaagaggcaagaaataatacctatacaacaatttacagtttcctacatgctttagtaatagcagctacttttatgcagctcccacttaagtgtccagtacaaatatgacttcacttagttttcatgacagtcctgtgtgatataattatcccttctgcagatgataaaatctgtaggcttaaagaggttagacgatgcatccaaagactcatagtaagtggcagaggagccaggcccactaatacacacacacacacacacayacacacacaaaactagcattcacataacatctgtgagtttacaaagcacctcagcaataatatatccccactatggggccaggcactgggctgagtgtgtgacatacacgtatctcgtgggatcctcacagcttccatgggatagatactgctatttgtcccactttgcagatcaataagttgatcaacagcacacctggggcaaagggcgaagagtcttacagcctccctgggtagtcggtgttactaatactctttccattttacagataaagaacctaggctcagagagttaatagg

SEQ ID NO: 82418 - DNA, 601 bp, Human
attcaagattttaaaaaataggtcatacatgcataatattttaaagatataagtatgtcttggaaaatttttcttgtagtcatccagttcctacttctctacatcctggaggaatagcacttattaacagtatattttctaaagatacttaaatctctaatttctgtatctcctaggtataattctgtgtgtatcttctagagataatctatctaataaagaatggaagcatattctttttttattttttttgagacagagtcttgctctgtcacccaggctggaatgcagtggcacaatytcagctcactgcaacctctgcctcccagtttcaagagattctcctgtcttagcctctcgagtagctggaattacaggcgtccaccaccacgcctggctaatttttgtatttttagcagttacagggtttcaccatgttggccaggctggtcttgaactcctgacctcaggtgatccacctgccttggcctcccaaagtactgggattacaggcgtgagccactgtgcccagtctttttttttttttttttttttttttttgagatggtacatccctctgtcgcttgggctggagtcctag

SEQ ID NO: 82419 - DNA, 601 bp, Human
accttccaccctgttcaccgaggtaactgctccagatctcagtgtaggtataacttcctttgggaaaccactctgacacactaagatgggttggatggctctctccacattgccattgtcatactatattgttaattagaagttccatgcactcagcacaatatcttgcacatggtaaatcttcaatagatagtagatagacagtaaatcttcaatagatagtagatggatagatggacggacagatggatggatggatggatggatgagtgggtgagtgggtggtggaggatggatagayggatggatcagtgggtgagtgggtggtagatggatggatagatggatggatggatggatggatggatgggtagacagatgagtggatggttggttggaatgaatgatgaataaatgaatgaatgagtgaattaatgaatgaggagctattcaaattagggcatgattagaatttggcagaaatgacccaaaagggctgattccctgccctactgtaagatggtccccaaaggaagcccgatcagctttctaggaagcactgccacccacaccctcctctgacttcctcagagctgaaaag

SEQ ID NO: 82420 - DNA, 601 bp, Human
tgagcaatctttccctttttgccccttataccgctgtccacccaggagttccagctagaaatctggggtcatctccaactccccattctccctcactcctgggctcaagccattttcaaaccctatcaatcttccctccttaattatctatcttattatctatctaccttaattcacactgccccaccccccttacctggtctgcagaagattgatttccctgcctccagtctgcctcataggagtctaattttcacactgctctcaagctaaaatctaaactcccctagccatgcatttkaggcttttcatgatctggtccatgctaaactatccaggctaatttctcagcagaccttctcctttgcaccccaacattatactttaactgtatcaaactgttctcagttctttcaaccaccagtttttctctattcatctctcttcctggattattctcctatgcaccagcaccaccttccaccctgttcaccgaggtaactgctccagatctcagtgtaggtataacttcctttgggaaaccactctgacacactaagatgggttggatggctctctccacattgccattgtcatacta

SEQ ID NO: 82421 - DNA, 601 bp, Human
ggaagagaacaggctccttgaccctgagcaaatctagaccagagaactggcctcgaaaagtccttaactccaagaatagccacctgagctgagcaatctttccctttttgccccttataccgctgtccacccaggagttccagctagaaatctggggtcatctccaactccccattctccctcactcctgggctcaagccattttcaaaccctatcaatcttccctccttaattatctatcttattatctatctaccttaattcacactgccccaccccccttacctggtctgcagaagaytgatttccctgcctccagtctgcctcataggagtctaattttcacactgctctcaagctaaaatctaaactcccctagccatgcatttgaggcttttcatgatctggtccatgctaaactatccaggctaatttctcagcagaccttctcctttgcaccccaacattatactttaactgtatcaaactgttctcagttctttcaaccaccagtttttctctattcatctctcttcctggattattctcctatgcaccagcaccaccttccaccctgttcaccgaggtaactgctccagat

SEQ ID NO: 82422 - DNA, 601 bp, Human
caacatgccacctgcccctgatgcccgctcttctcacaaaagcgggcagtggccccagcaggctggcactcactctcagggggcataggcccactgtcgatactgcccccgtggcccggtgtgttgcagaagggcggggcccagcccggcaggcagtggcagttctggttgttgttacagacctggagcaaagaaagggcagaggcatcagcaccccagagagcatcagccacccacagggcctgccctcatgacgtccccatgacacagagaagccagaacccagcacgcaccccatggycattgcacttcttcccacagccttcagtttcaaagaaggaggtgttcctgcactgcccctcaaagcaaatctgcacggagagaaaacagaacgatcagtgcaatgggagggatgctggttgggagttaggaggcaagattttgcacttggaacatatgaggacccatggcccggcctggtggctcacgcctgtaatcccagcactttgggaggctgaggtgggcggatcaccagaggtcaggagttcaagaccagcctggccaacatggtgaaactccatctctacgaaaaatacaaaaa

SEQ ID NO: 82423 - DNA, 601 bp, Human
cgagatcacaccactgcactccagcctgggtgacagagcaagactccgtctcaaaaaaaaaaaaaaaaacaaagaaacaaaaagactcagacagatttaagactagacatctcacccataatccataacttaacatttggtttcatcaaaactaccccaatattctctcaagtggttaatgtaaatatagagaacgtatttgtactaacaaaacactactttttatcagttttacatattggggtttcttccttgaaagattttggtgctttttttttaaagttatttgctattttttttwaaaaaaaaactttagaaatcatagtgctagaatccttgagagatccactaaaatactataaaattttctgagtgtctggttctccattttaacttgtgtccatcagaggaaatctaaaccaccataatgtgtcccaggttcatgattatttttaagtgcccaaagagaaatagtcaccgtgtcccctaaaaagaatgggaacattcaatgacctacagtctctcttactctcactctactaagcgggctccccctcctcagtagaaaggatgggagaagagagactgaaccgtgtcccca

SEQ ID NO: 82424 - DNA, 601 bp, Human
tcgagatcacaccactgcactccagcctgggtgacagagcaagactccgtctcaaaaaaaaaaaaaaaaacaaagaaacaaaaagactcagacagatttaagactagacatctcacccataatccataacttaacatttggtttcatcaaaactaccccaatattctctcaagtggttaatgtaaatatagagaacgtatttgtactaacaaaacactactttttatcagttttacatattggggtttcttccttgaaagattttggtgctttttttttaaagttatttgctatttttttwaaaaaaaaaactttagaaatcatagtgctagaatccttgagagatccactaaaatactataaaattttctgagtgtctggttctccattttaacttgtgtccatcagaggaaatctaaaccaccataatgtgtcccaggttcatgattatttttaagtgcccaaagagaaatagtcaccgtgtcccctaaaaagaatgggaacattcaatgacctacagtctctcttactctcactctactaagcgggctccccctcctcagtagaaaggatgggagaagagagactgaaccgtgtcccc

SEQ ID NO: 82425 - DNA, 601 bp, Human
gcacagtggctcatgcctgtaatcccagcactttgggaggccgcggtcagcagatcacaaggtaaagagatcaagaccatcctgaccaacatggtgaaacctcgtctctactaaaaacacaaaaattagctaggtgtggtggcacatgcctgtagtctcagctactcaggaggctgaggcaggagaatcacttgaacccgggaggcggaggttgcagtaagtcgagatcacaccactgcactccagcctgggtgacagagcaagactccgtctcaaaaaaaaaaaaaaaaacaaagaaacraaaagactcagacagatttaagactagacatctcacccataatccataacttaacatttggtttcatcaaaactaccccaatattctctcaagtggttaatgtaaatatagagaacgtatttgtactaacaaaacactactttttatcagttttacatattggggtttcttccttgaaagattttggtgctttttttttaaagttatttgctattttttttaaaaaaaaaactttagaaatcatagtgctagaatccttgagagatccactaaaatactataaaattttctgagtgtctg

SEQ ID NO: 82426 - DNA, 601 bp, Human
aattaaaaacacacattatgggccgggcacagtggctcatgcctgtaatcccagcactttgggaggccgcggtcagcagatcacaaggtaaagagatcaagaccatcctgaccaacatggtgaaacctcgtctctactaaaaacacaaaaattagctaggtgtggtggcacatgcctgtagtctcagctactcaggaggctgaggcaggagaatcacttgaacccgggaggcggaggttgcagtaagtcgagatcacaccactgcactccagcctgggtgacagagcaagactccgtctcaaaaaaaaaaaaaaaaacaaagaaacaaaaagactcagacagatttaagactagacatctcacccataatccataacttaacatttggtttcatcaaaactaccccaatattctctcaagtggttaatgtaaatatagagaacgtatttgtactaacaaaacactactttttatcagttttacatattggggtttcttccttgaaagattttggtgctttttttttaaagttatttgctattttttttaaaaaaaaaactttagaaatcatagtgctagaatccttgagagatccactaaa

SEQ ID NO: 82427 - DNA, 601 bp, Human
acagtggttaaaaagacaaagagggggctgggcatggtggctcatgcttgtaatcccagcattttgggaggccaaagcgggcagatcacctgaggtcaagagttcgagaccagcctggtcaacatggtgaaaccccgtctctactaaaaatacaaaaaattagctgggtatggtggcatgcacctgtagccccagctactcaggacgctgaggcaggagaatcgcttgaactcaggaggcggaggctgcagtgagccaagattgcaccactgcattccagcctgggcaacaagagtgaaamtccatctcaaaaataaataaaataaaatggggaataaatcaactagacaaaggatggcaaatagattttattttatatttcaacttgatttggttggggatattctgctgagaagaactcaggagtgatgaccagaatcagtagagtacttacaataagatcaactagtaatgcctgtcacagtcatagcaggggagagggcagcatgtatcttgcacttgtcttccctgaattagacccactatcaccaacacttttgctaagtaccatttatggagacctttgtgacccataaattga

SEQ ID NO: 82428 - DNA, 601 bp, Human
ttccatatccaaaataatacatcacttttcaaatgggacaccaaaagcgagcaggagtagctattcttataccagatgaaacaaactttaaagcaacagtggttaaaaagacaaagagggggctgggcatggtggctcatgcttgtaatcccagcattttgggaggccaaagcgggcagatcacctgaggtcaagagttcgagaccagcctggtcaacatggtgaaaccccgtctctactaaaaatacaaaaaattagctgggtatggtggcatgcacctgtagccccagctactcaggasgctgaggcaggagaatcgcttgaactcaggaggcggaggctgcagtgagccaagattgcaccactgcattccagcctgggcaacaagagtgaaactccatctcaaaaataaataaaataaaatggggaataaatcaactagacaaaggatggcaaatagattttattttatatttcaacttgatttggttggggatattctgctgagaagaactcaggagtgatgaccagaatcagtagagtacttacaataagatcaactagtaatgcctgtcacagtcatagcaggggagagggcagc

SEQ ID NO: 82429 - DNA, 601 bp, Human
ctctggagggagtgggattggtcttctcgaaccacatcttcctaagtagaaaaacgtgtggccaatggagaactctcaaggaaacagagttggccttatacaaagcagagctctctcagcaccttctcttcacccttttaagacccttcccctgtgaggagacacaagggtgtcacgagccatcaaccaatccccatcaggcatagatccagaaagacctgggacttaaaatcccctccagaacaagtgttatttaataggtgactcagagactgtacatcttccatatccaaaataatamatcacttttcaaatgggacaccaaaagcgagcaggagtagctattcttataccagatgaaacaaactttaaagcaacagtggttaaaaagacaaagagggggctgggcatggtggctcatgcttgtaatcccagcattttgggaggccaaagcgggcagatcacctgaggtcaagagttcgagaccagcctggtcaacatggtgaaaccccgtctctactaaaaatacaaaaaattagctgggtatggtggcatgcacctgtagccccagctactcaggacgctgaggcaggagaatcgc

SEQ ID NO: 82430 - DNA, 601 bp, Human
agctaaatctttcccaagtctgctctggagggagtgggattggtcttctcgaaccacatcttcctaagtagaaaaacgtgtggccaatggagaactctcaaggaaacagagttggccttatacaaagcagagctctctcagcaccttctcttcacccttttaagacccttcccctgtgaggagacacaagggtgtcacgagccatcaaccaatccccatcaggcatagatccagaaagacctgggacttaaaatcccctccagaacaagtgttatttaataggtgactcagagactgtacrtcttccatatccaaaataatacatcacttttcaaatgggacaccaaaagcgagcaggagtagctattcttataccagatgaaacaaactttaaagcaacagtggttaaaaagacaaagagggggctgggcatggtggctcatgcttgtaatcccagcattttgggaggccaaagcgggcagatcacctgaggtcaagagttcgagaccagcctggtcaacatggtgaaaccccgtctctactaaaaatacaaaaaattagctgggtatggtggcatgcacctgtagccccagctactcag

SEQ ID NO: 82431 - DNA, 601 bp, Human
cacacatcccaaggaccctccaaagcctgcagccaaccccagagtccttagggtcagagacagcttgggttccatggagccctctggattacacccagagaaagcagtctcagttgaggggtcacacccaaaacacacaggccagttccagaaggcaccccacccggccgccacccaggaaacacctgtgtctgcactgggggatctcctgcagaaggtgtggtcagagccatcagagcacacacacgcagtgggaacaggctgctgggcaggctatgcctccaagagcaccagggctggygggggagagtctagaccccactctcacctcccagaggcacctgccccttgggatgggcaaggcatcaggatacatccctaagactttccaatcagtagaaggtaccaataggtacaatttggtaggaagagtactatgatgagagaagtacagtcccatcaacctcagaattgaggaatcaggatagacttcctgggagaagcggcatctaggagcagatctgaggatgagcaggaggtggccccaccaaggagagaaggagcgtatcaggcagaacaagcagcatttacaaagacctag

SEQ ID NO: 82432 - DNA, 601 bp, Human
gccacacatcccaaggaccctccaaagcctgcagccaaccccagagtccttagggtcagagacagcttgggttccatggagccctctggattacacccagagaaagcagtctcagttgaggggtcacacccaaaacacacaggccagttccagaaggcaccccacccggccgccacccaggaaacacctgtgtctgcactgggggatctcctgcagaaggtgtggtcagagccatcagagcacacacacgcagtgggaacaggctgctgggcaggctatgcctccaagagcaccagggctggtgggggagagtctagaccccactctcacctcccagaggcacctgccccttgggatgggcaaggcatcaggatacatccctaagactttccaatcagtagaaggtaccaataggtacaatttggtaggaagagtactatgatgagagaagtacagtcccatcaacctcagaattgaggaatcaggatagacttcctgggagaagcggcatctaggagcagatctgaggatgagcaggaggtggccccaccaaggagagaaggagcgtatcaggcagaacaagcagcatttacaaagacct

SEQ ID NO: 82433 - DNA, 601 bp, Human
ctcagcacctaggggtgacaggggtgaggctggccccgtgttctctgaacatgcctctagtgtgggtttttcagaacaacagtctgagtggactgctcgcccgacccactccctcctccctctgctggcacccctgttctcctgtaaccccaagtctctacacgcctgctttctccctttctttcatctctctgttagggactgaactgtgcactcatcatttaaaaaaaaaaaatcatatgctgaagccctaaccctgagtacctcagaatgtgaccatatttagagataaggtctttawagaggtgattaggatagaatgaggccacctaatccaatctggtgtcctcataagaagaggagagttggacaggcagacaccagggaggcagaagtgcataggaaaggcctcgtgagaacacagcaagagggcggccacctgcaagccacagagagaggcttcagaaatcaacccttccagcaccttgaccttggactcttagcctctagaactgtgagaaaataagtgtctgttttgaagccacccagtgtgcagtactctgctatagcaccctcagcacacgagtacactctccacctc

SEQ ID NO: 82434 - DNA, 601 bp, Human
cttgacttccttcccttctcgagagggtcactaccacgtattaaagtggacaaaaggcaagcacatagagagggcaggaataacacaaagagccgagattttccccaagaagcttcatggaatcagaaactaaagcaaattcttaaggccaaaaagccatgttcttcagctctatctagaaggacaatacaacccgcccccttcaccaccaccttccccagctcagaatagctgccaagttgcaatggttgctggaagccaggatagagaccttctggggcaggtgacagctgggtgcagwtgtcaggttgcaactgggaaaggctgtgctcccaagggagctgtgcaaatgagccactgaggggctggagtttgggcaggagcctcatcagcatgtcagcactgggcctcccagggcaaccagccacaggccacatctgcgatgatccaactcagccctaccagggccctcgcccagcactgttttcctttttctagagcagaaacagtccctcagctactctggcccatgctcccttccacaagggatggcatcttactcaatcagattgcacaagcctgacacggggcgtcatcccct

SEQ ID NO: 82435 - DNA, 601 bp, Human
gtagaggatagttgacataaaataagtcagcacgctcaccgcctaatagaaatgtctgtaacagaaaaaaggaaggatacagaccaaagagattacactgggatggggtgcaaaaggggaggggtgtgttccaggtgaacattccatttttttttttttttgagatggagtcttgctctgtcccccaggctggagtgtaatggcatgatctcggcttactgcaacctctgcctccggagttcaaacgattctcttgcctcagcctcctgagtagttgggattacaggcacccaccaccatrcccagctaatttttgtatttttagtagagacggggtttcgccatgttggtcaggccaatctcgaactctgacctcaggtgatctgcctgccttggcctcccaaagtgctgggattacacgtgtgagccaccacgcccagcccttgaacattcctttttttttttttttaacaagagcatgtacgtgtattgcctgttaagattaaaacaaaatttaaacaaagcagcagctatattttgttcatgttggttgtccatgtgtgtggcacatttcatggattctgtccttcctgtgttacta

SEQ ID NO: 82436 - DNA, 601 bp, Human
agcaaagaaactataaataagcaaaatttcatcagcagaaaaataactaaaattataaagtgacagatgatatagcacttaaaaagaatgaagtaggttgataggggctggcgtggggagatgttcaagagttgttaggtggaacaaacaagctgtagaggatagttgacataaaataagtcagcacgctcaccgcctaatagaaatgtctgtaacagaaaaaaggaaggatacagaccaaagagattacactgggatggggtgcaaaaggggaggggtgtgttccaggtgaacattccatttttttttttttttgagatggagtcttgctctgtcccccaggctggagtgtaatggcatgatctcggcttactgcaacctctgcctccggagttcaaacgattctcttgcctcagcctcctgagtagttgggattacaggcacccaccaccatgcccagctaatttttgtatttttagtagagacggggtttcgccatgttggtcaggccaatctcgaactctgacctcaggtgatctgcctgccttggcctcccaaagtgctgggattacacgtgtgagccaccacgcccagcccttga

SEQ ID NO: 82437 - DNA, 601 bp, Human
catggatgatgctggaaactatcattctcagcaaaataacacaagaacagaaaaccaaacaccacatgttctcactcataagtgggagatgaacatgaaatgagaacacatggacacagggaggggaacattacatactggggcctgttgggtggtggggggctaggggagggatagcattaggagaaatgcctaatgtagatgacgggttgatgggtgcagtaaaccaccatggcatgtgtatacctatgtaacaaatctgcacattctgcacatgtaccccagaacttaaagtataataaaaaaaattacaaataactgttctctgatctagtaattctacttcttctgacctatgttagagaactatttgcacacgtgcacaaaaatgaaactgcaaggttgttccttgcagcactgtttgtaacagcaaagaaactataaataagcaaaatttcatcagcagaaaaataactaaaattataaagtgacagatgatatagcacttaaaaagaatgaagtaggttgataggggctggcgtggggagatgttcaagagttgttaggtggaacaaacaagctgtagaggatagttgacata

SEQ ID NO: 82438 - DNA, 601 bp, Human
agaaaaagaagggagggagagagacatcagcttgatgctgatcaatgggatcaagggggcagccatcctcccgattttagaaggaaggatggaccacccactgagaacaaaggcttcttgtgaagtccatccatgtgtccactcacccagaccatcagccctgcaggaaggggtgtggtaggtgcccctatctcaagctgaccagccacccctccctcttcccttccctgctaaggcagcagcacagtccatagttttctcaatgcctcgtgggaatacagcatggtcagccagcttcttyacctcatccctttctgacctgactgccaagactggcaaactgagactgtcagccacacagaagaagtacgaggaggggccaagtgtacacagcctcccgcaggccaggtggcttctactaatgcacttccttgctcttcacaacaacctgatggggctggtactactgctcatcatagcctctgtacaaatgaggaaacagactcaagagggacttgctcagggtccctccccaggtcaggtgcaggggcaggactgaagccaccacagctcaggattctaagaatcacctttcacatga

SEQ ID NO: 82439 - DNA, 601 bp, Human
cgcaggacgtgagcctgggcgtggtgagcgcggggtccgcaggctcctggggtctgcagagagattgggagagggaagccgggcccggactcctgggtccggaggaggcaggggccagattccaatatccaaagagtgactgaggatggggtctgtgctcccggcttcttgggtctgtcgggaagtttggggctgggatttggagctctggaaaggagctgaggtgcggagctgaagtccagacaagactggcaaacccgggactgaagcggggacctatggaggggagcaggcaggcatycggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctacccagccctgcctctgcacccagcctg

SEQ ID NO: 82440 - DNA, 601 bp, Human
gacctatggaggggagcaggcaggcatccggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctmcccagccctgcctctgcacccagcctgaccaccgcccaacagcctttagacctcagtgtgctcctggaacacggagctgtgaagatgctgatctcaggccccaaacccagagggcctcaggcgttcatctttccataagcatttatcaagaacctggtggctcatgccggtaatcccagggttttgggaggcggagactcaaggattgcttcaggccaggagtttgagaccagcttggccaacaaagtgagacccccccactctccaaggatttttttttttttttttgagacggagtat

SEQ ID NO: 82441 - DNA, 601 bp, Human
cggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctacccagccctgcctctgcacccagcctgwccaccgcccaacagcctttagacctcagtgtgctcctggaacacggagctgtgaagatgctgatctcaggccccaaacccagagggcctcaggcgttcatctttccataagcatttatcaagaacctggtggctcatgccggtaatcccagggttttgggaggcggagactcaaggattgcttcaggccaggagtttgagaccagcttggccaacaaagtgagacccccccactctccaaggatttttttttttttttttgagacggagtatccctctttttgcccaggctggagtgcaa

SEQ ID NO: 82442 - DNA, 601 bp, Human
gatggagaatggaaggcaggagccctgagaccaggcagaagacggctgcggagtccacacgagggatggtggcagaaggatgggtggcatatgtggccagaagtagttggattcggggtgtatattttggaggcagggccgaggaactcttctgtggggttaagtgggcaggaagagggaatttgaaggatctggctcactacaaggaaaggtaggccctgtgtctgtcctggtgactcacaaacagcctagaacagtgtctggcatctatatgtccttcatcactatttgccgcctcaayaaatgaggcgcagtttgaccttaatttggagatgaggctactggggatggagcccagctgggaaaggggaccccagagagacctaacccaggagggggtggcttgccacaggaggccagagacccagccggcctgggcactttggacctaatctgggtttgaggagaacttggcagtgatggtgtgaggcctgcacagctcccagggggttccagcctcaaagggtcctcactgcatacccagggctcctttctccagagtccgcccaccagggcccagggaagctggatgcaaaatcct

SEQ ID NO: 82443 - DNA, 601 bp, Human
tgacgccactccaaagggcagtaggaatggcttggtaggagctggcttccagagacagactgcctgggttcaaacctgggctgtggggccttcgagggcacatttcttgagccctctgagcctcagttttcccatgtagaaagttgactggtgctatgattaaggcaggctctcctattgtggacacaccccccaccgccaaatgtctcccgcagacccagggacagtggccaccatgcgtaagccccgctgctccctgcctgacgtgctgggggtggcggggctggtcaggcggcgtcgycggtacgctctgagcggcagcgtgtggaagaagcgaaccctgacatggaggtaggtcctggggcccacccgcaccctggccctgcctgctgggctccggctttgaatggctgcctgctccctccacggccacccttacacctcactcccctctccccagggtacgttccttcccccagagctcccagctgagccaggagaccgtgcgggtcctcatgagctatgccctgatggcctggggcatggagtcaggcctcacatttcatgaggtggattccccccagggccaggagcccgacat

SEQ ID NO: 82444 - DNA, 601 bp, Human
gcatctagactggtgtttcaccaaccagctgggcacgacagccgggccaaactgacacacacaatgaaccatcacagaggcctagcaggtgcctagctccaagccagagctgggggcttgcggagacgaaaacaaatctttacctggcagctgagtcagaagagtgactggcaatgacaacacccacggtgacacagctccacagaatcccagcagaggaagtcctcaagcctgcaggggctcagagatgttggcccaaagctcttgggcaaggggaggcttcctagaagaggtgacttcrttccctcaatatatatatgaatataggccgggcgtgattgctttcatctgtaatcctagcacttcgggaagcacaggtgggtggatcacctgaggtcaggagtttgagaccagcctgaccaacatgttgaaaccccgtctctattaaaaatacaaaaaattagccgggtgtggtggtgcaagcctgtaatcccagctactggagaggctgaggcaggagaatcagttgaatcctggaggcagaggttgcagtgagccgagatcgtgccactgcactccagcctgggcaacaagagcaaaa

SEQ ID NO: 82445 - DNA, 601 bp, Human
ggatgagggagttgtgagcgctcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacrgatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatg

SEQ ID NO: 82446 - DNA, 601 bp, Human
gcgctcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggyggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacag

SEQ ID NO: 82447 - DNA, 601 bp, Human
atggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggtggggatggatggatggacagatgcatacacagaggcagggatgaatggacagatgcatgcacagaggcrgggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacaga

SEQ ID NO: 82448 - DNA, 601 bp, Human
gaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacagaggcggggatggatggacagatgcatgcacagaggcagggatggatggatgcacagatgcatgcacagaggcggggatggatggacagatgcatgcacagaggcggggatggatggacggacggatgcatgsccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcct

SEQ ID NO: 82449 - DNA, 601 bp, Human
cccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccgrtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggt

SEQ ID NO: 82450 - DNA, 601 bp, Human
gccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccagrctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcacc

SEQ ID NO: 82451 - DNA, 601 bp, Human
ggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagrcagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctg

SEQ ID NO: 82452 - DNA, 601 bp, Human; identical to SEQ ID NO: 82439

SEQ ID NO: 82453 - DNA, 601 bp, Human; identical to SEQ ID NO: 82440

SEQ ID NO: 82454 - DNA, 601 bp, Human; identical to SEQ ID NO: 82441

SEQ ID NO: 82455 - DNA, 601 bp, Human; identical to SEQ ID NO: 82442

SEQ ID NO: 82456 - DNA, 601 bp, Human; identical to SEQ ID NO: 82443

SEQ ID NO: 82457 - DNA, 601 bp, Human; identical to SEQ ID NO: 82444

SEQ ID NO: 82458 - DNA, 601 bp, Human; identical to SEQ ID NO: 82445

SEQ ID NO: 82459 - DNA, 601 bp, Human; identical to SEQ ID NO: 82446

SEQ ID NO: 82460 - DNA, 601 bp, Human; identical to SEQ ID NO: 82447

SEQ ID NO: 82461 - DNA, 601 bp, Human; identical to SEQ ID NO: 82448

SEQ ID NO: 82462 - DNA, 601 bp, Human; identical to SEQ ID NO: 82449

SEQ ID NO: 82463 - DNA, 601 bp, Human; identical to SEQ ID NO: 82450

SEQ ID NO: 82464 - DNA, 601 bp, Human; identical to SEQ ID NO: 82451

SEQ ID NO: 82465 - DNA, 601 bp, Human
gcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgttgggggggggggggaggtggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtcca

SEQ ID NO: 82466 - DNA, 601 bp, Human
ttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttccyttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatct

SEQ ID NO: 82467 - DNA, 601 bp, Human
gtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatartagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaa

SEQ ID NO: 82468 - DNA, 601 bp, Human
ttacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaaktttcttcataaggaaactaaagggaagcatagtcaaaactgctacaagttgggctggacgtggtggctcactcctgtaatcccagcactttgggaggccaaggcgagtggatcacctgaggtcaagagttagacctgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatg

SEQ ID NO: 82469 - DNA, 601 bp, Human
aacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctkagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagag

SEQ ID NO: 82470 - DNA, 601 bp, Human
gccactgcactccagcctgggggacagagcgagactccgcgccactgcactccagcctgggggacagagcgagactccgtctcaaaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttgktggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttca

SEQ ID NO: 82471 - DNA, 601 bp, Human
aatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcartaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaa

SEQ ID NO: 82472 - DNA, 601 bp, Human
ttaaaaaagattcaatgggtattttgcaccatggggtgtgttttcagaagtcctaacagcataatgcactatctaaatataattggttaagtaacaggacaacaccacatgcctcctaatataatgcactgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaarccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaaca

SEQ ID NO: 82473 - DNA, 601 bp, Human
atgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgyggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagacttgtctcaaaaaaaaaaaaaaaaaaaaaaaaaaa

SEQ ID NO: 82474 - DNA, 601 bp, Human
tgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagcttt

SEQ ID NO: 82475 - DNA, 601 bp, Human
cctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctcwgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctca

SEQ ID NO: 82476 - DNA, 601 bp, Human
cgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagartctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggca

SEQ ID NO: 82477 - DNA, 601 bp, Human
ttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccrtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaat

SEQ ID NO: 82478 - DNA, 601 bp, Human
tgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagcgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagc

SEQ ID NO: 82479 - DNA, 601 bp, Human
aacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaatgtttatttctattatcacaataacaccagacaccatgctagaagctggaagcacaatattctggtaattcataatctagctgtagagacaaggctatcattccttccattacaatacactttacaagaattgcagggcacrgtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacg

SEQ ID NO: 82480 - DNA, 601 bp, Human
tcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaactttaacgcccagtcactgtcaatacaattgtgaatgcagctggcacatgaatttgtggtttaaagcagaatgctttgggcagcaataytttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaa

SEQ ID NO: 82481 - DNA, 601 bp, Human
acgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaactttaacrcccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttggga

SEQ ID NO: 82482 - DNA, 601 bp, Human
agagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtamcggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaactttaacgcccagtcactgtcaatacaattgtgaatgcagctggcacatgaatttgtggtttaaagcagaatgctttgggcagcaatattttaagtttgaagttagtgttcagtt

SEQ ID NO: 82483 - DNA, 601 bp, Human
gaaaatggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagyaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttcttttttttttttttgagacagagtctcgctcttttgcccaggctggagtgtagcggtgtgatctcagctcactgcaacctctgcctcccgggttcaagcaattctcttcctcagcctc

SEQ ID NO: 82484 - DNA, 601 bp, Human
ttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaayggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgt

SEQ ID NO: 82485 - DNA, 601 bp, Human; identical to SEQ ID NO: 26572

SEQ ID NO: 82486 - DNA, 601 bp, Human; identical to SEQ ID NO: 26573

SEQ ID NO: 82487 - DNA, 601 bp, Human; identical to SEQ ID NO: 26574

SEQ ID NO: 82488 - DNA, 601 bp, Human; identical to SEQ ID NO: 26575

SEQ ID NO: 82489 - DNA, 601 bp, Human; identical to SEQ ID NO: 26576

SEQ ID NO: 82490 - DNA, 601 bp, Human; identical to SEQ ID NO: 26577

SEQ ID NO: 82491 - DNA, 601 bp, Human; identical to SEQ ID NO: 26578

SEQ ID NO: 82492 - DNA, 601 bp, Human; identical to SEQ ID NO: 26579

SEQ ID NO: 82493 - DNA, 601 bp, Human; identical to SEQ ID NO: 26580

SEQ ID NO: 82494 - DNA, 601 bp, Human; identical to SEQ ID NO: 26581

SEQ ID NO: 82495 - DNA, 601 bp, Human; identical to SEQ ID NO: 26582

SEQ ID NO: 82496 - DNA, 601 bp, Human; identical to SEQ ID NO: 26583

SEQ ID NO: 82497 - DNA, 601 bp, Human; identical to SEQ ID NO: 26584

SEQ ID NO: 82498 - DNA, 601 bp, Human; identical to SEQ ID NO: 26585

SEQ ID NO: 82499 - DNA, 601 bp, Human; identical to SEQ ID NO: 26586

SEQ ID NO: 82500 - DNA, 601 bp, Human; identical to SEQ ID NO: 26587

SEQ ID NO: 82501 - DNA, 601 bp, Human; identical to SEQ ID NO: 26588

SEQ ID NO: 82502 - DNA, 601 bp, Human; identical to SEQ ID NO: 26589

SEQ ID NO: 82503 - DNA, 601 bp, Human; identical to SEQ ID NO: 26590

SEQ ID NO: 82504 - DNA, 601 bp, Human; identical to SEQ ID NO: 26591

SEQ ID NO: 82505 - DNA, 601 bp, Human; identical to SEQ ID NO: 26592

SEQ ID NO: 82506 - DNA, 601 bp, Human; identical to SEQ ID NO: 26593

SEQ ID NO: 82507 - DNA, 601 bp, Human; identical to SEQ ID NO: 26594

SEQ ID NO: 82508 - DNA, 601 bp, Human; identical to SEQ ID NO: 26595

SEQ ID NO: 82509 - DNA, 601 bp, Human; identical to SEQ ID NO: 23628

SEQ ID NO: 82510 - DNA, 601 bp, Human
tcatgatataacatttataacttctttaacaaacaatcatagactgtaagcattacagctttccttcttctataataaagagtgctttgtttataatatggagtcgattacttctgacttgctctgatgaaggcttatatctaattatctgtttcccatcccttcaggggacaatggcaaaaaaactatttttctgtggtcaggacccattttctcttacaacaatggctcacagacacttctggcaagacttctgtttcattgtatagcatgatgtaaaccaccttaaaatgggaatcartcaatgactgactcagaaaagtagctgcacaaagactgtataagctccctaattataataacgtgttccctctctttgcagatcccaagttgcctaccttcatttacctagagctctacaagtggcaataatgaatgtgatggagccctaactttattaagcagatactaataatgataaagttaatttaagatagtgtcaagaaagaaataacaatttagaaacattcccatctctctatgctggagactagttcacagcaggagcagagagcactaaggaacctgcagccacttgata

SEQ ID NO: 82511 - DNA, 601 bp, Human
aataggaacttttacctggggaatcttgtgtcatacatatctccatactttgaaacatagataccattctaacccagccttggtcctgatttcttccaagcccctctacggacagggtctggtcagactgtgggactcaggttacccagtggcttcttcctatcactatgcaggaagccctttgagctaccacaggacatcacttgttcttaatatttgctgtgaatcagcattcacctgttattcactcaagcttggtatctcaaatctgacatgtagaaaatctgctgattttttactcaattatgttaccagattttaacctctctgtgttttaagactgattctttatcacctgcatgtatatcagtttgcatattgctttcagttatttcaggtaatgaagccagcatcaggaaacattctctgatgaaccagggcttgtttttttctgacttctgcttcatggagagcagtatatacacaattgtaggcatatcctgtttaaccaggccttgataatttgataattttgtaaatttaaaatgagcaagaagccttcctgtagtaacatcttaatttgtgtttttgccttgaatgt

SEQ ID NO: 82512 - DNA, 601 bp, Human
agcattttattttgttggatattgccaagttcctctccagaaggatgtatcaggttgaattcccaccagatcatcttgtatctcactgttcagaaaatggattttttttctagatatgtcacattttctgacttaattacaaaattttctttggaaacttttcacattcacgtttagatatttggactgagcaaagctgagctcactaagctcatgtacacagtaataggaacttttacctggggaatcttgtgtcatacatatctccatactttgaaacatagataccattctaacccakccttggtcctgatttcttccaagcccctctacggacagggtctggtcagactgtgggactcaggttacccagtggcttcttcctatcactatgcaggaagccctttgagctaccacaggacatcacttgttcttaatatttgctgtgaatcagcattcacctgttattcactcaagcttggtatctcaaatctgacatgtagaaaatctgctgattttttactcaattatgttaccagattttaacctctctgtgttttaagactgattctttatcacctgcatgtatatcagtttgcat

SEQ ID NO: 82513 - DNA, 601 bp, Human
gtcactatttttagcatctgttgataattcttgcttataacttactgtgatgtttgactaaaagtaattttctattttcattccttctacatttattagagttctaatgtgagcaagaactgccctttctcctctatttattttatttacttatttaatcatttagttgtatcagtgtagatctatagtagatcagtgtagatttatcatatgggtaacactttactatcactatttatctcattgctcaactcgtcccagattagttcactgagagctccttcaagctgtagcccaggtwctatggacgtgcttccatcatattttcagtgcgtctttccttctgacattacaatatatgccaggcttatctaatattttttctgcttcagccttagaatcgaccatttctcccaagggctctggttgctttcattggataatggtagatagacaacaagattatcacactaggtgtagtcattacttctaggccctctcaggtggaaagttaagaaatctatgtttatataccagcacatgaatacacacatctacatttatttctcgtctatctgtttctatatataagcttaagttt

SEQ ID NO: 82514 - DNA, 601 bp, Human
agttatacatttttttttgcaaatgtcaccaaagtgatgttctgccattttcagtgtcttgtattaagggattcatgatgttgacatgactttttctggtgctgtgaccttaactttgatcacttggttaaggtgttctctgccaggtttctctaccacaaagtgttatgtaccattttgtcactaaaaagtaccatttgaagagacagtttgaagactatgcaaataaagattcatcatacttccataattttttcagtcactatttttagcatctgttgataattcttgcttataactyactgtgatgtttgactaaaagtaattttctattttcattccttctacatttattagagttctaatgtgagcaagaactgccctttctcctctatttattttatttacttatttaatcatttagttgtatcagtgtagatctatagtagatcagtgtagatttatcatatgggtaacactttactatcactatttatctcattgctcaactcgtcccagattagttcactgagagctccttcaagctgtagcccaggtactatggacgtgcttccatcatattttcagtgcgtctttcctt

SEQ ID NO: 82515 - DNA, 601 bp, Human
ctgtattttccttgcatctttgatagttccttattctttccttgtctttcatgtctttgacattttagaagttgactggctatgattttgtagaatatccctcaatttgggttttttgatgtttccttattattagattgaagttatacatttttttttgcaaatgtcaccaaagtgatgttctgccattttcagtgtcttgtattaagggattcatgatgttgacatgactttttctggtgctgtgaccttaactttgatcacttggttaaggtgttctctgccaggtttctctaccacraagtgttatgtaccattttgtcactaaaaagtaccatttgaagagacagtttgaagactatgcaaataaagattcatcatacttccataattttttcagtcactatttttagcatctgttgataattcttgcttataacttactgtgatgtttgactaaaagtaattttctattttcattccttctacatttattagagttctaatgtgagcaagaactgccctttctcctctatttattttatttacttatttaatcatttagttgtatcagtgtagatctatagtagatcagtgtaga

SEQ ID NO: 82516 - DNA, 601 bp, Human
catttcaccagtttcccactaatgtccttctgctccatgacccaatccaggattcctcattgcatttagtcattatgtttctgtattttccttgcatctttgatagttccttattctttccttgtctttcatgtctttgacattttagaagttgactggctatgattttgtagaatatccctcaatttgggttttttgatgtttccttattattagattgaagttatacatttttttttgcaaatgtcaccaaagtgatgttctgccattttcagtgtcttgtattaagggattcatgatrttgacatgactttttctggtgctgtgaccttaactttgatcacttggttaaggtgttctctgccaggtttctctaccacaaagtgttatgtaccattttgtcactaaaaagtaccatttgaagagacagtttgaagactatgcaaataaagattcatcatacttccataattttttcagtcactatttttagcatctgttgataattcttgcttataacttactgtgatgtttgactaaaagtaattttctattttcattccttctacatttattagagttctaatgtgagcaagaactg

SEQ ID NO: 82517 - DNA, 601 bp, Human
aaggaaaacgaactgggcaactagctcctaatgtatttttagaaactagcaaccaatagacattcatctaatactctggtgtctcccaaatctaccaataaggaaagcagagaataattgtgtgtatctgcatgtggtgctggttcatgtagttttccaggtaaattatctctgacattgtagttgagcagtgatctgaatgaattgaagaaaccagtcatgtacaaatccaatggaggaacattgcagacagagatcacagacccttcaaggcccttagataggaaattactgagtgtgyacaacatatatcaagaaatccagtgtggtagggcagaagccttaaaataaatagaggttgggatatgcaagctctgtaaaccaaagtaagaagtttgaaatttaatagaaagttaatgggaagtcattggtgggtattaagtgaagagaggatatagtatcgttttttgttttttaaatcatactggctggcattgcatctgtgagtcaagtgtgtatgccaaaacaaacaaacaaacaaaactaatacaaaaagcaattaggtagttgaaaagataaccaagatgagaggcaatggagc

SEQ ID NO: 82518 - DNA, 601 bp, Human
tagcgaaagctccaagtagtcatcagcagtgatgggttctccatctacttccagttccagggtgaaatctctgagagtccacacaaatgctggaaaaaagctcacaaagtcagctgagtcgtctacagaattgttaccaggtgaggagtttgccttgattcgatctgtcagctctgtcacatagctgagatgctaaattaagaaaactacagaaaatgccactctttatactacattttatcctaatgcttacctaaaataatttggtttccttttattagctcattcattcattcacaarcatttatttacagaattcattcactcacaaacatttattgagcacctactatgaaccaagcactgccctagggactaagaacgctgtaatgaatgagacaatgctaccactatagagcttacattctaatgatggagacaaacaatgaacaggtaaacaaaaataaattatcaggtattgataacaattgtcttgaaggaaaacgaactgggcaactagctcctaatgtatttttagaaactagcaaccaatagacattcatctaatactctggtgtctcccaaatctaccaataaggaa

SEQ ID NO: 82519 - DNA, 601 bp, Human
tagctcaccatagccttgaactcctgtgctcatgctgggtcctcctgcctcagcctcctgagtagctaggactctgggcaagcaccactgcacttggctgatttttaactttttcataatgatgaggtcttgctacttttcccaggctggtcttaaacttaaactcctgggctcaaggaattctcccaccttggcctcccaaaatgctgggattacaggcattagcctcctgtgttctattttcttgaagttgcaaagttctatcctgccctatgcatttccacattacattatttgctawaaagctattcctctatatgctttggttagctcttaaccatttatttaatatatatatatatattggagacagggtctcactctgtctcccaggctggagtgcggtggtgcagtctccgctcactgcaacctctgcctcccaggctcaagtgatccttcagactcagccagctgagtagctgggattacaggtgttagccaccatgcctgattaatttttgtgtttttagtagaggaagggtttccccatgttgcccaggctggtctcaaactcctgagctcaaagtgattcacccacctc

SEQ ID NO: 82520 - DNA, 601 bp, Human
ccaggcacagaaagaaaaccattgcatgttctcacttatttgtgggatttgaaaatcaaaacaattgaattcatgaagatagagagtagaaggatggttgtcagaggctgagaggggtaatggggtggtggggggagggaggtggggatggtttaataggtaaaaacaactagaaagaatgaataaaatcaagtatagcacaacatacttgagagcataaaacttgatggcacaaaagggtgactatagtcaataataatttaattgtacactttaagataactaaaaaagtgtaattggrttgtttgtaacacaaaggataaatacctgagtcgacaaataccccattttcaatgatgtgattattgtgcatttcatacttatatcaaaacatctcatgtaccccataagtatatacacctactatgtaccatatgtacccacaaaagtaaaaaaataaaaaaattacaaatttcggatattagtaatacatattttatagaattgctctgagtattaaatgaataacgctctcagcccagttcctggaacacagtaagtgcaacataaatgttaactgttattattatttgttcataag

SEQ ID NO: 82521 - DNA, 601 bp, Human
ggaatgagcccaaatgcccatcaattaatgagtggataaaaaattgtttcatatatatgtaaaacatataatacccccccacacacaccatggaatactactcagccataaaaaggaaaaagacaatggcatccatagcaacctggatggaactgcagactattattctaagtgaagtaactcaggaatggaaaaccaaacatcctatgttctcacacataaattggagataagctattatatgaggccacaaaggcataagaatgatacagtggactttgaggacttgtgggaaaggagrgggggcaagggataaaagactacacactgggtacggtgtacaccaaaatctcagaaatcaccactaaagaacttattcatgtaaccaaacaccacctgttccccccaaaacctatatgaaatgaaataattttaaaaactctacaatatctctaatgaaaattgatgcaaaagtcctcaataaagtactagcaaaccaaattcaacaatacattaaaaggatcactcatcatgaccaagtgggattcatccctgggatgcaaggacggctcaacatatgcaaatcaatcaatgtgataaa

SEQ ID NO: 82522 - DNA, 601 bp, Human
gggtcttctcttgctctgccattaactgggccctgtccctctccatcttctcagtcaattgtttcacatgttcctgataactcttctctttctgttccatcatctcctcattcttcttttgtatttcctccaacattttctttgcagcttctgcagattcagcctttatacgttccactgtggaagaaaaataagcagaaaaagatatgaatattcaattgtaggtgttcccttttcctttccctcgtttttgtttgtcttatccttacatcattgagaaaacttcttgtaattttgcctygggtaaccagaaaaccaatgatcatacagattagttaagaaaactctcatagaactatgaatgatacttgccattctttctctacaataataattccaggtggaccaatattgctaactaacattttgagagctttccgaccatgtagagtgttttcagctgttctcaccttcaatcgctttttccttttctgagagtgactgatcagtctgtagaagtgcatcagccacatcctccttggactccaaatattttttcagcacctctttggcctggttatacagagaaaggtagaatgaa

SEQ ID NO: 82523 - DNA, 601 bp, Human
tggcaccatgggcacttaaccagtgtgcttaagtgggtagatggttagggaatctttctttcttttttttttttttgagatggaatttggctcttgttgcccaggctggagtgcaatggcgccatcttggctcactgcaacccccgcctcccaggttcaagcgattctcctgcctcagcctcctgcatagctgggattacaggcatgcgtcactatgcccagctaattttgtatttttgatagagacggggtttctccatgttggtcaggctagtcttgaactcccgacctgaggtgatcygcccccgtcggcctcccaaagtgctaggattacaggtgtgagccactgcacctggcctggttagggaatctttctactcataacagtgcttccagacataaagtcttagcaggcataacagaaacaaaatccccatggatccctctcagtaggaaagactggctagatatttctctaggtagtctgatgcagaaaagttacttactgctcatgagattataattacttcatttagcaaatgagaaactaatagttcctctaccattagaggaaaatttgatcacataatgtaaaatactt

SEQ ID NO: 82524 - DNA, 601 bp, Human
gaaaagagcccagagaacaagaaagtattggcaccatgggcacttaaccagtgtgcttaagtgggtagatggttagggaatctttctttcttttttttttttttgagatggaatttggctcttgttgcccaggctggagtgcaatggcgccatcttggctcactgcaacccccgcctcccaggttcaagcgattctcctgcctcagcctcctgcatagctgggattacaggcatgcgtcactatgcccagctaattttgtatttttgatagagacggggtttctccatgttggtcaggctrgtcttgaactcccgacctgaggtgatctgcccccgtcggcctcccaaagtgctaggattacaggtgtgagccactgcacctggcctggttagggaatctttctactcataacagtgcttccagacataaagtcttagcaggcataacagaaacaaaatccccatggatccctctcagtaggaaagactggctagatatttctctaggtagtctgatgcagaaaagttacttactgctcatgagattataattacttcatttagcaaatgagaaactaatagttcctctaccattagagga

SEQ ID NO: 82525 - DNA, 601 bp, Human
gctatttctgggcaaacgtaaatgtggaaaagagcccagagaacaagaaagtattggcaccatgggcacttaaccagtgtgcttaagtgggtagatggttagggaatctttctttcttttttttttttttgagatggaatttggctcttgttgcccaggctggagtgcaatggcgccatcttggctcactgcaacccccgcctcccaggttcaagcgattctcctgcctcagcctcctgcatagctgggattacaggcatgcgtcactatgcccagctaattttgtatttttgatagagayggggtttctccatgttggtcaggctagtcttgaactcccgacctgaggtgatctgcccccgtcggcctcccaaagtgctaggattacaggtgtgagccactgcacctggcctggttagggaatctttctactcataacagtgcttccagacataaagtcttagcaggcataacagaaacaaaatccccatggatccctctcagtaggaaagactggctagatatttctctaggtagtctgatgcagaaaagttacttactgctcatgagattataattacttcatttagcaaatgagaaa

SEQ ID NO: 82526 - DNA, 601 bp, Human
ggttcaacaaaaatgcatgcatcatgattttgagttaagtttaatggcagttgtttgacactctgaagttgctcattcatgttgtttcttggggagagggagctggacaggcaaattttgctccttggacttttagagtatgttacatattggctccaatgatttgcttctcatctggatatcccatatgtctttttgaagtctcttgctctcattctcgaatccctccttgagaaggcgttcctgttcctaaaagggaaagtggagactaagcctatccagcttaacacatttccaccarattagttccccttttggtacttatattgatccttcaagaatttttgactatcactctcttctgagtctcctatacctgccaataatttttctatgatttttttagcttcaaaaatgttgttgttctacagtttctaaaatattagtgacccagcgttttattccttggtcccttcaccatttgcactcatgcaacacagtctttctggaaaaaccataactttctcttgttctttttgttgttgttgttcatttctgatctatatagaatggactcttaaatatatatctaggaaggtat

SEQ ID NO: 82527 - DNA, 601 bp, Human
ggggtgttctggacttgggtcatattgaaggaaatcctgcacaagatgtcaacatgtcaagaggcattgatctcaacaccaagaatatattgaatgagtggatctctagaagagagaatttgaggaaaggaatcagaagtggactacaatagggacgtgctattgggaggtcctggcaagggggatcagcaaagaacccaaatcatccttaaggacttaagccaccaccagaaggtgccaacaccagatcagttatgtatcatgtaaggtttcttttccttaattccctgcactctagtgwtaacaacttgaaggtatcatcaacatgagctagtgtacccagtgggagggagagctggaaatgaaaataaaaagtcgtacacctttctcactgtgtgcctgtaaggctgaatcaggcctgggctgtgtgactgagtggaatctgagggggagcaagatacaaggggaggaactttaaatcaaaactcagacatttaaaaatttaggtcaaatgttattttttttttttagaaaaagagactattcatttatctgagagtgactaatgaacaaacaggaaagaaatgttccgattaagtaa

SEQ ID NO: 82528 - DNA, 601 bp, Human
tgcattcaggctgggtgcagtggctcacgcctataatcccagtgctttgggaggctgaggcaggcagatcacttgaggtcaggagttccagaccaggctggccaacatggcgaaacccgtctgtactaaaaatacaaaaattatctgggcatggtgatgtgtgcctatcatcccagccacttgggaggtggaggcaagagaattgcttcaacccgggaggcagaaattgcagtgagctgagattgcgtcactacactccagcctgggtgacagagtgagactctgcctaaaaaaaaaaaaatatatatatatatattatatatatatatattacatttagtgcctattatacagtagatattgtgttaaattctttataggtattatttatgaaatttaatttattcctcagtacaagcttgttgatgtaagttatcatcctcattttacagcaaatatactactaagactttttttttaaagtcttccaacagtttattagaaagaatgtaggcatttaaaaaaatccccactgtcatgaacataaattgaggttttcagccctggtataagctgaatcaaaaaaagaaaaaatccggcc

SEQ ID NO: 82529 - DNA, 601 bp, Human
attatattttcatgtagtaatttttaaatcatactttcaccttataatacataagtttcattgcagcattgaaccctgggttagtgttataataaaaagtatattgcattcaggctgggtgcagtggctcacgcctataatcccagtgctttgggaggctgaggcaggcagatcacttgaggtcaggagttccagaccaggctggccaacatggcgaaacccgtctgtactaaaaatacaaaaattatctgggcatggtgatgtgtgcctatcatcccagccacttgggaggtggaggcargagaattgcttcaacccgggaggcagaaattgcagtgagctgagattgcgtcactacactccagcctgggtgacagagtgagactctgcctaaaaaaaaaaaaatatatatatatatattatatatatatatattacatttagtgcctattatacagtagatattgtgttaaattctttataggtattatttatgaaatttaatttattcctcagtacaagcttgttgatgtaagttatcatcctcattttacagcaaatatactactaagactttttttttaaagtcttccaacagttt

SEQ ID NO: 82530 - DNA, 601 bp, Human
ggctttttaatattaactaaattgagaggtggaaaatggcatgctattttcataagtttttaaatattactgagatgaattatattttcatgtagtaatttttaaatcatactttcaccttataatacataagtttcattgcagcattgaaccctgggttagtgttataataaaaagtatattgcattcaggctgggtgcagtggctcacgcctataatcccagtgctttgggaggctgaggcaggcagatcacttgaggtcaggagttccagaccaggctggccaacatggcgaaacccrtctgtactaaaaatacaaaaattatctgggcatggtgatgtgtgcctatcatcccagccacttgggaggtggaggcaagagaattgcttcaacccgggaggcagaaattgcagtgagctgagattgcgtcactacactccagcctgggtgacagagtgagactctgcctaaaaaaaaaaaaatatatatatatatattatatatatatatattacatttagtgcctattatacagtagatattgtgttaaattctttataggtattatttatgaaatttaatttattcctcagtacaagc

SEQ ID NO: 82531 - DNA, 601 bp, Human
gacatccagatggaattaatgaccttatcagaagaagaagagatctttctcttcttgtctgtgaaaaagcagagaggaaaggccagatgaggacacagtaagtaggcagccatctgcagcccaaggagagaacacttcccaccctctagaactgtgagaaaataaatttctgttgtttaagccacccagtatatggcttttttttttcggacagccctagtgttgcaggacttttccttagttcagctaaagacggggttcttgtccaccccacggacatgaaaatttaggcttccaggargtttaaagggtgagtgaagcagggttttattgggtgaaaagggaaaaaagaggggaaacagggactctcgcaaagccagagtccctctgctagagggctttccgccaggcacttgaatctgaggttccacccaggaagaggaggggccaggctcgggctcctccctgctgcaaaagtcctgaatttccccaggctccacctcagcgggctggcttgttggagtttctccaggaccccctcccacctggctgtctcactagcagtctaacacactgacctatgtgtgacctatatcaactt

SEQ ID NO: 82532 - DNA, 601 bp, Human
ttaaaagtaaacgggcttccaaaggtacccatgttggggaggtcttgtaattcatggcaacatcctgtccctgagtaaaaaatactaacatgaagagtcctcttcccttcttctaaactttcctatatgttcctataaaagccttccaacttgtagcagattctggaaaactcccaactgtgttggtatgtcttccaggatttatcctcatatttgtcttccaatatacttttatcaaattttttgtctcagccttattttggtggatacttctaaaaattctttctcatgatccaggtaygaagggaactataaagtttaaactttgtactgaattaagctgaattaagaactctaataaaagatttccctaaactcaaataaggttggcaaatattcatagaatttagaattcttttggatgaacatgacccagggttacctgattgttatagatggaatgtttttgctttgttcccccaaactcaactgttgaagccctaacttccagtgtgacagtatttggagatgggctctttgggatgtaattagggttaaattagctcatgagggtgaggacatccagatggaattaatgacc

SEQ ID NO: 82533 - DNA, 601 bp, Human
aacaaatgactaattttattagtaaatcctgctcttctttgcctacatctacctccccatattcagctttctctattcccccttatatttctgatttccctgcttcaacacctcatactccttcctcctcttactcagacctctagcttttcccaactctcctgaaacccccaaatgccaaggacctctgatacaggtcacatttgacagtttactttaaaagtaaacgggcttccaaaggtacccatgttggggaggtcttgtaattcatggcaacatcctgtccctgagtaaaaaataytaacatgaagagtcctcttcccttcttctaaactttcctatatgttcctataaaagccttccaacttgtagcagattctggaaaactcccaactgtgttggtatgtcttccaggatttatcctcatatttgtcttccaatatacttttatcaaattttttgtctcagccttattttggtggatacttctaaaaattctttctcatgatccaggtatgaagggaactataaagtttaaactttgtactgaattaagctgaattaagaactctaataaaagatttccctaaactcaaataag

SEQ ID NO: 82534 - DNA, 601 bp, Human
tataatttacattttgttgtgttatctggtactataattttttccaatacattgtgatatggtttggctctgtgtccctgcccaaatctcatcttgtagctcccataattcccatgtattgtaggagggacctggtgggagatgattgaataatgggggcaggtctttcccatgctgttcttgtgacagtaaatgggtctcatgaaatctgatggttttaaaaatgggagttgccctgcacaagttctctctttgcctgatgccatccatgtaagatgtgatttgctcctccttgccttcygccatgacttccccagccacgtggaattgtaagtccaattaaacctctttcttttgtaaattgcccagtcttgggtatgtctttatcagcagcatggaaacagactaatacacattgttttggctcatccttccatttttgaacagaaactaggatcatattatgaagttcctacaaaattttcattggcattgtattggatacagtaggccaatataaattgatcaatagatatttaatatttttacttctttgctttcactttagatcatggtctgttgctccatttattctaaaccc

SEQ ID NO: 82535 - DNA, 601 bp, Human
tgtggactctaaaacaactgaattaatagaagcagagagtagaatggtagttaccagaatgtgagggtgggagaaatggagagatgatggttaaaggataaagaatttaatttagacaggagtaattaggttttgtgtggttttttttttgacatttattgcactgcatggtgaatatggtcaataatggtatattgcatatttcaaacttgctaggtgagtaaatttcaaatgttcttatcacaaaaatgacaaatatttgaggcgatgagtatgtttattaatttaattattccacatygtattcatgaacataacattacttagcactttataaatatatacaatcatacattgtcaatttacaataagttttcttattaaaaaaatttaaagtacttattttaatgtcagttatgtacaatagatttttttttaataatggctagagagttgttcttatttgtattgaaatgttttctggatcatccatttagtcccattgtctgctgatttttattatactcagtgccatactttaaaatgattataatttacattttgttgtgttatctggtactataattttttccaatacatt

SEQ ID NO: 82536 - DNA, 601 bp, Human
gtattggatgaccttgctagagcaattaggaaagagaaagaaataaaaagcatccaaataggaaagaataaagtgagattttttctgtttgctaattattctatgtatgtatacctaaaacttcagcaagacactatcagaagtaataaataaatacattaaagtttcagaatacaaaatcaacatccgagaattaggtagaatttctatatattatcatcaaactatctaaaaaagaaaccaagaaaataatctcacttatgatagctacaaaaataaaataaaataaaataaaataaaacaaaatacttagaaataaatttaacaaaggaggtaaaagacttgtacactaaaaccttaaaaaatgttgataaaagaaattgaagaagacataaataaatggaaaaatattccatattcatggattggaagaatatggttaaaatgttcagattgctacccaaagtgatctacaggttcattgcaattcttatcaaaattccaatgtctatttcacaaaaatagaaaaaaatcctaaaatttacgttgagttacagaaaactcccaaatagccaaggaaatcatgatcataagaaacaaa

SEQ ID NO: 82537 - DNA, 601 bp, Human
atactacttcttctcaaactcttccaaaatattgaagggaagggaatactttaaaactctttttacaagtccggcattaccctgataccaaagttgaacaaggacattacaagagaagaaaattataggccaatatccttgatgaatacacatgcaaaagtcctcaacaaaatataaacaaaccaaattcaacaacacattaaaagtatcactcaacatgaccaagtgggatttatccctgagaagtaagatggttccatatatgcaaaacaataaatgtgatacatctcatcaacacaaygaaagacaaaagccatatgatcattttattaaatgcagaaaaagtatttgataaaattcagcatgctttcataatgaaattctcaacaaagtaggtatagaaataatgtaactcaataccataaagaacatattaatataccataatcctgtagcttactttatactcaagcatgaaaaattgaaagccttttatctaaaatcttgcacaaaacaaggatgcttattctcaccatttgtattcaacacagtattggatgaccttgctagagcaattaggaaagagaaagaaataaaaagc

SEQ ID NO: 82538 - DNA, 601 bp, Human
gggttaatcaattctttatattattggtaaggcttctggtcaatagtaggatattagtagttaagttttggggaagtcaaatattatacatagatttttgtttgtgtggtgagacggtgtccatagcccttgtactgttgaagggtcaactatatattcactcaacatcaaagcatctaaatgtataaagcaaatattaaatgatctgaaggtagagaaagattgcaatacaataacagtagaggactttagtgctccggtttcaacaatggacaaatcatccaatcagaaaattaagackgaaacattggacttgaataatacttcggaccaagttaacttaataaacatatacagaatattccacctaacagcaacataacacatattcttcgcaatgacacatggatcatcactaaaatagatcacacattaggctacaaaacaagtcctaacaaatttaagaaattttaatcataccaagtatcttttctgacaataatggtataaaactagaagtcaataacaggaataatttcagaaaattcccaaatacatagaaatcaaacaacatgctcctgaacaaccaatgggtcaatga

SEQ ID NO: 82539 - DNA, 601 bp, Human
tacgtatataaaaatgggttaatcaattctttatattattggtaaggcttctggtcaatagtaggatattagtagttaagttttggggaagtcaaatattatacatagatttttgtttgtgtggtgagacggtgtccatagcccttgtactgttgaagggtcaactatatattcactcaacatcaaagcatctaaatgtataaagcaaatattaaatgatctgaaggtagagaaagattgcaatacaataacagtagaggactttagtgctccggtttcaacaatggacaaatcatccaawcagaaaattaagactgaaacattggacttgaataatacttcggaccaagttaacttaataaacatatacagaatattccacctaacagcaacataacacatattcttcgcaatgacacatggatcatcactaaaatagatcacacattaggctacaaaacaagtcctaacaaatttaagaaattttaatcataccaagtatcttttctgacaataatggtataaaactagaagtcaataacaggaataatttcagaaaattcccaaatacatagaaatcaaacaacatgctcctgaacaa

SEQ ID NO: 82540 - DNA, 601 bp, Human
taattttttttttctttgtagagaaggggtcttgctttgttggccaggctagcgttgaacttctggtttcaagagatcctcccatcctggcttctcaaagtgttagaataataggcataagccaccatgtccccccttcttatgattttcttaataacattttgttttctctagcttacttcattataagaatacagaatataatacgtatataaaaatgggttaatcaattctttatattattggtaaggcttctggtcaatagtaggatattagtagttaagttttggggaagtcaaawattatacatagatttttgtttgtgtggtgagacggtgtccatagcccttgtactgttgaagggtcaactatatattcactcaacatcaaagcatctaaatgtataaagcaaatattaaatgatctgaaggtagagaaagattgcaatacaataacagtagaggactttagtgctccggtttcaacaatggacaaatcatccaatcagaaaattaagactgaaacattggacttgaataatacttcggaccaagttaacttaataaacatatacagaatattccacctaacagcaacataa

SEQ ID NO: 82541 - DNA, 601 bp, Human
gtgaagacagatttctatttaatccccttgaactaaagaaagctattttttggtgttttctttctttttactttaagttctggaatacatgtgcagaacctgcaggtttgttacataggtatacatgtgccatggcggtttgctgcacctatcaagtattccatggtgtatacgtgccacattttctttatccagtctatcattgatgggcatttgggttggttccaagtccttgctattgtaaatagtgctgcaataaacgtatgtgtgcatgtgtctttatagtagattgatttataawcctttgggtatatacccagtaatcacagaaacttttattcatcaaggacttattttgagaaatgagatcagcgagatgatgaaatatatttcaggcttcactctctccttcagaaatttcaactagcgattaaccatagactggaagatgtttgtgaaagtcccagtacagtacttggaaacaagcctaaaacacctgagggtccacagaactgagtaaaactgaattagaagggtaagaaaaatggtctcactttgaccacgctgcccctcctattccctcacgtcagcacaataccac

SEQ ID NO: 82542 - DNA, 601 bp, Human
ttaatgtctaccactagagctaatgaaacagtgaagacagatttctatttaatccccttgaactaaagaaagctattttttggtgttttctttctttttactttaagttctggaatacatgtgcagaacctgcaggtttgttacataggtatacatgtgccatggcggtttgctgcacctatcaagtattccatggtgtatacgtgccacattttctttatccagtctatcattgatgggcatttgggttggttccaagtccttgctattgtaaatagtgctgcaataaacgtatgtgtgyatgtgtctttatagtagattgatttataatcctttgggtatatacccagtaatcacagaaacttttattcatcaaggacttattttgagaaatgagatcagcgagatgatgaaatatatttcaggcttcactctctccttcagaaatttcaactagcgattaaccatagactggaagatgtttgtgaaagtcccagtacagtacttggaaacaagcctaaaacacctgagggtccacagaactgagtaaaactgaattagaagggtaagaaaaatggtctcactttgaccacgctgcccc

SEQ ID NO: 82543 - DNA, 601 bp, Human
atacttttaagtggtttaaagataacatacagattatcacattagaaacacaaagttattcaagaaaatgttcaccaaaaatatttttttctgtgtttacacattcataagacatttaattccaagaaggagatttaatgtctaccactagagctaatgaaacagtgaagacagatttctatttaatccccttgaactaaagaaagctattttttggtgttttctttctttttactttaagttctggaatacatgtgcagaacctgcaggtttgttacataggtatacatgtgccatggcrgtttgctgcacctatcaagtattccatggtgtatacgtgccacattttctttatccagtctatcattgatgggcatttgggttggttccaagtccttgctattgtaaatagtgctgcaataaacgtatgtgtgcatgtgtctttatagtagattgatttataatcctttgggtatatacccagtaatcacagaaacttttattcatcaaggacttattttgagaaatgagatcagcgagatgatgaaatatatttcaggcttcactctctccttcagaaatttcaactagcgattaacca

SEQ ID NO: 82544 - DNA, 601 bp, Human
gttgttaaaaatagtttaaatgaaatgtctacttgtgatgacaaagggaaggaaatataaaataagtggtaggggagggataggatgaacgtcaattctgcctttgattgaagttgcaggagcaaactgtggtatgtgccaccaactcctgtgtattaagttttttgtagaactgtagctggttatgaacttgaggacttggtaacagactgaatttaatgtagggcaggcacagtgatcagagtgctgaaggggtgaactgtgtcagatgcatctgatacactgactcatcctctcaatrtctcctctcatcccagctgtgactggaatggagagttcaaaggaattcaagctgatagcatcttgctttaggacagatgtttcttgtctttctgttcaatcctaaggccatttctatacaacggacacttttttttttctgtattaagagtctgtttatttcagtattaaggtaaaagaacctagttataataagtgtttttcatatctttcttcatcattctcacaacaaatatatgagaagaatgacgcttaaaaggtatgtaactttctgaggtgaggcaactagtaggttgtagaa

SEQ ID NO: 82545 - DNA, 601 bp, Human
cacagatcaatgtgcattttcttaatttttattctttatggatacataatagttgtatgcatttatgggttacatgtgatattttgatacaaaaataaaatatgcaatgatcaaatcaggataattgggatatccttcacctcaagcatttatcatttctttgtgttcggaatattccaattccactcttttagttttttgaaatatgggtacaaaaatatagttagaagaaataagattaatgttgttaaaaatagtttaaatgaaatgtctacttgtgatgacaaagggaaggaaatayaaaataagtggtaggggagggataggatgaacgtcaattctgcctttgattgaagttgcaggagcaaactgtggtatgtgccaccaactcctgtgtattaagttttttgtagaactgtagctggttatgaacttgaggacttggtaacagactgaatttaatgtagggcaggcacagtgatcagagtgctgaaggggtgaactgtgtcagatgcatctgatacactgactcatcctctcaatgtctcctctcatcccagctgtgactggaatggagagttcaaaggaattcaagctgata

SEQ ID NO: 82546 - DNA, 601 bp, Human
ccaaaggccatggtaaattagggtgtgctcgaatatgagtaatacaaaatgggaaatttctttttcttacagtttgttgtaacaaattaaacagctcgtttaactgataatccatactatatttgagtagggctgtcacatggttggaacctccggttgaggtttatgttaataatagtgtttggatgcctgagcctacagatacttgtgggcctctcacccagaggaggaaggaatgttaataaatgtgtccatgggttatcagttccctcctgtttgcatagttcccttggctgcgggygggaggtccccggcttcttgcacttcctgggtgaagcaacgccccaccctgcttctgttcgccctcagttggttgaacccactgcttaaccgtcccaatgagatgaactgggtacctcagttggaaatgcagaaatcacttgccttctgcgtgggtttcacggtgctgcagaccggtgctgttcctattcggccatcttggtccctcccctcaactggcactctttaaataataaaaatcttatgagaatcatcaaaccgtttgctgaatttgatccattctctcatgagtacttggaaa

SEQ ID NO: 82547 - DNA, 601 bp, Human
taccagttagatgttctgcaggggtaatggtctgatttctataaatgttcaaaaaatttaaagtatagagtattagattaagttgcatctggggagtgttaatactccttactgtttcttccttttttttttttgtttaaccaattgagctttcagtgttctattagttctttaaattatggcctgtctttgggaattatagggaattcctgttttatgtgtaatttttcactgatttaagaatttttgaaaagctttactacagtatcctggcccattgtccattttaatttttttttttaactctcatgacagcaaaacaagataataaatgtcttttaacatgggaagtactttctcctctctggcaggttgcccatatgaaatgtgaataagtatcaactgtcacatggacaaatgacaattttccaaatgaaggtacatgcgtgacatccatttgccataacacattaggacttagacctctgggattaactcctgcctcctgagtgggcaggtgtagaatctgacaccgggtgcaatcttgtacaatattttttggctgtttccatgtgatatcaaatttatttttaatcctgct

SEQ ID NO: 82548 - DNA, 601 bp, Human
atgacaactttatctgtaagttgtaggtacctaaactggaaggtgtttttttcctggggaaatacaagcaaaacctctcccacatgtcatcactttccgtgtttcccatgttttatttttattatctttctaccaaatcagttttccttcatgtgggctgttccttttaccagttagatgttctgcaggggtaatggtctgatttctataaatgttcaaaaaatttaaagtatagagtattagattaagttgcatctggggagtgttaatactccttactgtttcttccttttttttttttgtttaaccaattgagctttcagtgttctattagttctttaaattatggcctgtctttgggaattatagggaattcctgttttatgtgtaatttttcactgatttaagaatttttgaaaagctttactacagtatcctggcccattgtccattttaatttttttttttaactctcatgacagcaaaacaagataataaatgtcttttaacatgggaagtactttctcctctctggcaggttgcccatatgaaatgtgaataagtatcaactgtcacatggacaaatgacaattttccaaat

SEQ ID NO: 82549 - DNA, 601 bp, Human
tccgctttcttggtggatgacaactttatctgtaagttgtaggtacctaaactggaaggtgtttttttcctggggaaatacaagcaaaacctctcccacatgtcatcactttccgtgtttcccatgttttatttttattatctttctaccaaatcagttttccttcatgtgggctgttccttttaccagttagatgttctgcaggggtaatggtctgatttctataaatgttcaaaaaatttaaagtatagagtattagattaagttgcatctggggagtgttaatactccttactgtttyttccttttttttttttgtttaaccaattgagctttcagtgttctattagttctttaaattatggcctgtctttgggaattatagggaattcctgttttatgtgtaatttttcactgatttaagaatttttgaaaagctttactacagtatcctggcccattgtccattttaatttttttttttaactctcatgacagcaaaacaagataataaatgtcttttaacatgggaagtactttctcctctctggcaggttgcccatatgaaatgtgaataagtatcaactgtcacatggacaaa

SEQ ID NO: 82550 - DNA, 601 bp, Human
aatgttatcttttatgttggtatcattagtactttgcctaatgtctcttttgatatttcacatatgtctataaaatgtctattcaggatgagaggacataaaataaattacatagcattttgtatctgtataaaataaatatggtctaaataagtattgtcagaatactatgcagccataaaaaagattgagattgtgtcctttgcagcaacatggatggagatggagttcattatcctaagcaaactaacacaggaacataaatccaaataccacaagttctcgcttataagttggagcyaaacatttattacatagggacacaaagaaaggaacagcagacaccagggccttcttgagggttgagggatgagagtgagggttgaaaactacctatcaagtactatgctgattacctgggtgatgaaatcatttatataccaaatccctgtgacatgcaatctacctatataatgcttgcacatgtacccctgaacttaaaagttggaaaataaataaaaataaatgttgtcagaccatgctttattgacaccatatactaagcaaatgacttaactgtttttgtctagtgttcatactg

SEQ ID NO: 82551 - DNA, 601 bp, Human
tctctatgcctcctttcatcatcttctcaataagcacatcaatacctaattcatattattttgtgaggctgaattgggataatgtacataaaagtcttaacacattattagaggctcattttgaactttgaaaacttagtaacactttcaattaagtattaaaacacatttcccaaacttagtatttgaatgtatgctccttctaaaaatgttttcagagcacaaaatatgtaataatgttatcttttatgttggtatcattagtactttgcctaatgtctcttttgatatttcacatatrtctataaaatgtctattcaggatgagaggacataaaataaattacatagcattttgtatctgtataaaataaatatggtctaaataagtattgtcagaatactatgcagccataaaaaagattgagattgtgtcctttgcagcaacatggatggagatggagttcattatcctaagcaaactaacacaggaacataaatccaaataccacaagttctcgcttataagttggagccaaacatttattacatagggacacaaagaaaggaacagcagacaccagggccttcttgagggttga

SEQ ID NO: 82552 - DNA, 601 bp, Human
ggtgggcagatcacgaggtcatgagtttgagaccagcctggccaacgtggtgaaaccccgtctctactaaagatacaaaaaattagccgggcgtggtggcatgtgactgtaattccagctactcgggaggctgaggcaggagaatcgcttgaatctgggaggcgaaggttgcagtgagctgcgattgtaccattgcattccagcctgggtgacggggagagattctgtctgaaaacaacaacaacaacaacaataacaacaaaacagacagtaacaatctatgctcttccaagtcaggtaraagtttctgtattaattatctgatattgcataagaaataccctctaaatgtagtgaactgaaacgtttattgtctcatagtttctaaagttcacaagaatctaggaagaagggggataattatctttgtcatattgctgagacataaaataaaatgaggatggagaattgaccattcgacctatcagcatggagcaggcaggtcatgagagggactgattgtgtgggactcttgatattgagattatggaggaggtttagttactggtaaggaaaagtttcaggctgaggtgagatgata

SEQ ID NO: 82553 - DNA, 601 bp, Human
aaggaagtcagtcatacagcaaaacattgtgtatgtttcagtttatataaagaataaaaaggagacaatagctggatgcggtggctcacacctgtagtttcagcactttgggaggccgaggtgggcagatcacgaggtcatgagtttgagaccagcctggccaacgtggtgaaaccccgtctctactaaagatacaaaaaattagccgggcgtggtggcatgtgactgtaattccagctactcgggaggctgaggcaggagaatcgcttgaatctgggaggcgaaggttgcagtgagctgmgattgtaccattgcattccagcctgggtgacggggagagattctgtctgaaaacaacaacaacaacaacaataacaacaaaacagacagtaacaatctatgctcttccaagtcaggtaaaagtttctgtattaattatctgatattgcataagaaataccctctaaatgtagtgaactgaaacgtttattgtctcatagtttctaaagttcacaagaatctaggaagaagggggataattatctttgtcatattgctgagacataaaataaaatgaggatggagaattgaccattcgacc

SEQ ID NO: 82554 - DNA, 601 bp, Human
tattgagttaaggaagtcagtcatacagcaaaacattgtgtatgtttcagtttatataaagaataaaaaggagacaatagctggatgcggtggctcacacctgtagtttcagcactttgggaggccgaggtgggcagatcacgaggtcatgagtttgagaccagcctggccaacgtggtgaaaccccgtctctactaaagatacaaaaaattagccgggcgtggtggcatgtgactgtaattccagctactcgggaggctgaggcaggagaatcgcttgaatctgggaggcgaaggttgcmgtgagctgcgattgtaccattgcattccagcctgggtgacggggagagattctgtctgaaaacaacaacaacaacaacaataacaacaaaacagacagtaacaatctatgctcttccaagtcaggtaaaagtttctgtattaattatctgatattgcataagaaataccctctaaatgtagtgaactgaaacgtttattgtctcatagtttctaaagttcacaagaatctaggaagaagggggataattatctttgtcatattgctgagacataaaataaaatgaggatggagaattgac

SEQ ID NO: 82555 - DNA, 601 bp, Human
tggcaagaatgtagagcactggggagccttaatattgctgatgagagtataaattgtgacaatcatattaaaaatctatttgatattatgtactatgaggtgaaaaaatgcatactatatattgaatacttctactcctaagtatctgtagtgaaatattattacagaacccaaaagctttcacatatattttaatacataatattgagttaaggaagtcagtcatacagcaaaacattgtgtatgtttcagtttatataaagaataaaaaggagacaatagctggatgcggtggctcacrcctgtagtttcagcactttgggaggccgaggtgggcagatcacgaggtcatgagtttgagaccagcctggccaacgtggtgaaaccccgtctctactaaagatacaaaaaattagccgggcgtggtggcatgtgactgtaattccagctactcgggaggctgaggcaggagaatcgcttgaatctgggaggcgaaggttgcagtgagctgcgattgtaccattgcattccagcctgggtgacggggagagattctgtctgaaaacaacaacaacaacaacaataacaacaaaacagacag

SEQ ID NO: 82556 - DNA, 601 bp, Human
tgccaagggctaataaatggtggaacatatcatggttatggactggaagactgactattttgtgagtctaatttttccacaaatatatctatatattcaatgtaattgccagacttatacatatagtgagttgatttatggtaacgatagtgaaaggataatcttctcaataaatggtgtcaggccttctatacacgttagaaagaaataaaacctggttcttaccctcctgacattaaaaataaggcaattccaaatggattatagatctaaatgtggaagataaaacaatcaaacttayagaaaaaaaaagtcaatgacattattttcacattctccagattgggaaactgatacaaaactataatattaagtgtaaaaaaaaaaagtcaatacatttaactacattaaaattgagaactgacaaagatataattaagagactgaaaaggcaaatcaaagattaaaaacatattatatatataattagaatatgtaatgcagtcttcaaatctacaaaaaaatagaagtaaaagtcttaaataagctcatccaaaagaggatctcctaatgaacagcaaacatgaacacatgttcaact

SEQ ID NO: 82557 - DNA, 601 bp, Human
cttccactggggctgtttcaactgccaggacatttcatggcatgtgcagctgatgctctggtaaaaattcacctaaacctcagggtcctcaaaatgcctaatttgatttaagctcatgtctctgttgtgacatattttgccacaaagtttccaaagcaatggtgtctgtgcactatgtggaactcccataggttttctgtagaatttccttttcacttgtagtggaatggctatttggataatgtattacaaaaatgtaaaaaataaggttcattgtttaatattaatgtcagactccaarattcctgatagagagggaaatgtatgttcttggaaacaaacttgaaatgcatattggagaagaggcatagctccaacaatttaagtatcagcagatacctaagcaagaaaaaatgactattaaattgctttgttaaaaaattttgtttgttttgaaaaacaaggtagtgagtagagggaagaggatagaatataggagaggacagactgaaactagcaaggtagaagtaggctgggctcttgtggagtgaagggctgtggttaccctcaaagttatgatggtcagagaaatcctaggaag

SEQ ID NO: 82558 - DNA, 601 bp, Human
tctttgtaaaaagatttcaagaagtgactgccttaaacacttgctgttgaaaacaacagcaaaaggaaggtgtttctcctctgtccccagcaagttgcacacacttccagtcattgtgtttaaaacggttttgtataaggtcttgcataaagaaaagctctttggtcaatccaaggcagctggagatgttgtttcctgtgattgtgattgagattaaaactgaaatcaatgaatagctacttacataataggcttatttctaagatccactcctttactgttcttgtagaacaataagttkatttttaaaaatataaatctatagaattcttcatgagagccatctgctaatgattaaataaaccactgtacctgaagttgccttcagacccaatattcttccactggggctgtttcaactgccaggacatttcatggcatgtgcagctgatgctctggtaaaaattcacctaaacctcagggtcctcaaaatgcctaatttgatttaagctcatgtctctgttgtgacatattttgccacaaagtttccaaagcaatggtgtctgtgcactatgtggaactcccataggttttctgtaga

SEQ ID NO: 82559 - DNA, 601 bp, Human
ccagcttcctaaaatgaccagcctctttgtaaaaagatttcaagaagtgactgccttaaacacttgctgttgaaaacaacagcaaaaggaaggtgtttctcctctgtccccagcaagttgcacacacttccagtcattgtgtttaaaacggttttgtataaggtcttgcataaagaaaagctctttggtcaatccaaggcagctggagatgttgtttcctgtgattgtgattgagattaaaactgaaatcaatgaatagctacttacataataggcttatttctaagatccactcctttaytgttcttgtagaacaataagtttatttttaaaaatataaatctatagaattcttcatgagagccatctgctaatgattaaataaaccactgtacctgaagttgccttcagacccaatattcttccactggggctgtttcaactgccaggacatttcatggcatgtgcagctgatgctctggtaaaaattcacctaaacctcagggtcctcaaaatgcctaatttgatttaagctcatgtctctgttgtgacatattttgccacaaagtttccaaagcaatggtgtctgtgcactatgtgg

SEQ ID NO: 82560 - DNA, 601 bp, Human
ccgctttgggaacgtctgtcttttacagttgtagataagggatgaaataagccccggtctcccgtagcgctccccagcttattaggacaaggaaattcctgcctaataaattttggtcagaccagttgtctgctctcaaagcctgtctcctgataagatgttatcaatgacaatgtgtgcccgaaacttcattagcaattttaatttcaccctgtcctgtgatctcaccctgcctccaactgccttgtgatcttttgttgcccttgaagcatgtgatctctgtgacccacaacctattcaygcactccctcccctttgaaaattgctaataaaaacttgctggttttatggctcagggggcatcacagaacctgccaacatgtgatgtccccctggacacccagctttaaaatttctctcttttgtaccctttccctttatttctcagaccagctgacacttagggaaaatagaaaagaacctatgtgaaatatcgggggtgaattttccccaataattaaccaatttttctgagtgaaaatcaggatcactttgtgaattgcaccagcactggatttgtactggatgtgtgccaaatata

SEQ ID NO: 82561 - DNA, 601 bp, Human
gtcatcttcgtaagctgaggatgaatgtcgcctcaggaccctgtgatgattgcattaacagcacaaattgtttaaacaatatgaaatctgggcaccttgaaaaaagaacaggataacagcgatgttcagggaacaagggagataaccttaaagtctggctgcctgtgggctgggtggaacagagccatatttctcttctttcaaaagcaaataggagaaatgtcgctgaattctttttctcagcaaggaacatccctgagaaagagaatgtgttcctaaggggaggcctctgaaatggccrctttgggaacgtctgtcttttacagttgtagataagggatgaaataagccccggtctcccgtagcgctccccagcttattaggacaaggaaattcctgcctaataaattttggtcagaccagttgtctgctctcaaagcctgtctcctgataagatgttatcaatgacaatgtgtgcccgaaacttcattagcaattttaatttcaccctgtcctgtgatctcaccctgcctccaactgccttgtgatcttttgttgcccttgaagcatgtgatctctgtgacccacaacctattcatgc

SEQ ID NO: 82562 - DNA, 601 bp, Human
gaagtagagattagaactgtgattattagaggctgggaaaggcagaggggagaggacagtagggagaggtttgttaacagctacaatattatagctagatgggggaataagtttaagtgtgctatagtattgtagggtgaatatagttaacaataatttattgtatattttcaaaatgctaggagagaggattttgaatctatctaacacaaagaaattataaatgtttgaggtgatgcatgtgagaaacacgctcacctgtccaaacccgaagaactgacttagaggcacgaagaacagygaaagtgagacttaataatggtgttgcaagatcgggcacatggtagacaggcacacatggggcagttacaacaggtaatttatctcctagcatgcaagtccctaccccagttccttgatggttgagtactatggggttaaaatcttcccagacatcgcctaagtttcaatatcccccttataaggttatactctctccccttccccgcttaagttttgatttcccaataacgaaactttattcccttttatgtgctgacccctcatctacattctgtttgcttattgtgaccttctaggt

SEQ ID NO: 82563 - DNA, 601 bp, Human
tagaagaaatatatgcactccatgtttattgtagcactattcaaaatagctgatactgcatcaacctaaatatccaactacagatgaatgcataaagacagtatagtgtagctacacattggattagtattcagtcataaaagtgaaatcctgtcattcaagacaacatggatgggcctacataattaaaatgaaataagccaggcacagaaagataaatgttcacacatatgaaagctaaaataagttgagcttatggaagtagagattagaactgtgattattagaggctgggaaaggyagaggggagaggacagtagggagaggtttgttaacagctacaatattatagctagatgggggaataagtttaagtgtgctatagtattgtagggtgaatatagttaacaataatttattgtatattttcaaaatgctaggagagaggattttgaatctatctaacacaaagaaattataaatgtttgaggtgatgcatgtgagaaacacgctcacctgtccaaacccgaagaactgacttagaggcacgaagaacagtgaaagtgagacttaataatggtgttgcaagatcgggcacatg

SEQ ID NO: 82564 - DNA, 601 bp, Human
atagcgtggctactcctcaaggatctagaaccagaaataccatttgacccagcaatcccattactgggtatataccaaaaggattataaattattctactgtaaagacacatgcacacctatgtttattgcagcactatttactatagcaaagacttataaccaatccaaatgcccatcaatgatagactggataaagaaaatgtggcatatgtacatcatagaatactatgcagccataaaaaagaatgagttcttgttctttgcagggacatggatgaagctggaaaccatcatcctcrgcaaactaacacagggacagaaaaccaaacataacatgttgtcattcataagtgagagctgaacaatgagaacacatggacacagggagggtaacatcacacattggcccttgttttgggggtagtgggcaagggagggagagcattaggacaaatacctaatgctcgcagggcttaaaacctagataatgggttgataggtgcagcaaaccaccatggcacatgtatacctatgtaacaaacctgcacgttctgcacatgtatcccagaaattaaacctcactaatcatcagtgaaatg

SEQ ID NO: 82565 - DNA, 601 bp, Human
ggactgtgaaaagaccaaatctacgattcattgatctacccaaaagtgatggggagaatgaaaccaagttggaaaacacacttcaggatattatccaggagaacagcaagacaggccaacattcaagttcaggaaatatagagaacaccactatgatactccttgagaagaataactccaagacacataatctttagattctccaaggttgaaacgcagaaacacacgttaagggcagctagagagaaaggtcaggttgcctacaaagggaagcccatcaggctaacagtggatctctctrcagaaaccctacaagccagaagacagtgggtgtcaatattcaatattcttaaagaaaagaatcttcaacccagaatttcatatccagccaaactaagcttcataagtgaaggagaaataaaatcctttccagacatgcaaatggtgagggattttgtcaacaccaggcctgccttacaagagctcctgaaggaagcactaaatatggaaaggaaaaacaggtaccagtcaccacaaaaacataccaaaatatagggaccatcaacactatgaagaaactgcatcaactaaggtgcaaaat

SEQ ID NO: 82566 - DNA, 601 bp, Human
caaactcctctgagctaaaggagcatgttctaacccaatgcaaggaagctaagaaccttgataaaaggttatgggaactgctagctagaatattcagtttagagaagaatataaatgacctgatggagctgaaaaacacagcacgagaacttcctgaagcatacaaaagtatcaatagccaaatcaatagtggaagaaaggatatcagagatttaagattaacttactaaaataaggtgtgaagtcaagattagagaaaaaagaataaaaaggaaggaacaaagcctccaagaaatatggractgtgaaaagaccaaatctacgattcattgatctacccaaaagtgatggggagaatgaaaccaagttggaaaacacacttcaggatattatccaggagaacagcaagacaggccaacattcaagttcaggaaatatagagaacaccactatgatactccttgagaagaataactccaagacacataatctttagattctccaaggttgaaacgcagaaacacacgttaagggcagctagagagaaaggtcaggttgcctacaaagggaagcccatcaggctaacagtggatctctctac

SEQ ID NO: 82567 - DNA, 601 bp, Human
gctggctctgaagagagcagtggatcctgacaaggaggattctcccagcacaacgctcgagctctgctaaggaacagactgccttctcaagtgggtccctgactaggagagacctcccaacagcgacacctcataccagagagttccagctgtcatcaggccggtgcccccctgggacataacttttggaggaaggagcaggcagcaatccttgctgttgtgcagcctctgctggtgataccaggcaaacagggtctggagtggacctccagcaaactgcaacagacttgcaaaagagagrcctaaccatgagaaaaaaactaacagaaagcaataacatcaacatcagcaaaacggaccccccctccacaaaaacccagtccaaaggtcatcagcctcaaagatcaaaggtagacaaatccacaaagatgaggaaaaaccagcacaaaaatgctgaaaattccaaaaaccagaatgcctcttctctaaatgatcccaattcctctccagcgagagcacaaaactggacagagaataagtttgacaaactgacagaagtaggcttcagaaggtaggtagtaacaaactcctctgagctaaa

SEQ ID NO: 82568 - DNA, 601 bp, Human
tcctgcccgctggctctgaagagagcagtggatcctgacaaggaggattctcccagcacaacgctcgagctctgctaaggaacagactgccttctcaagtgggtccctgactaggagagacctcccaacagcgacacctcataccagagagttccagctgtcatcaggccggtgcccccctgggacataacttttggaggaaggagcaggcagcaatccttgctgttgtgcagcctctgctggtgataccaggcaaacagggtctggagtggacctccagcaaactgcaacagacttgcaraagagagacctaaccatgagaaaaaaactaacagaaagcaataacatcaacatcagcaaaacggaccccccctccacaaaaacccagtccaaaggtcatcagcctcaaagatcaaaggtagacaaatccacaaagatgaggaaaaaccagcacaaaaatgctgaaaattccaaaaaccagaatgcctcttctctaaatgatcccaattcctctccagcgagagcacaaaactggacagagaataagtttgacaaactgacagaagtaggcttcagaaggtaggtagtaacaaactcctct

SEQ ID NO: 82569 - DNA, 601 bp, Human
cctcactgggcagagcatctctgaaagaaaggcagtagccccagtcaggggcttatagataaaaaaaactcccatcccactgggacagagcacctggggcaaggggcggctttgggcacagcttcagcagatttaaactttcctgcccgctggctctgaagagagcagtggatcctgacaaggaggattctcccagcacaacgctcgagctctgctaaggaacagactgccttctcaagtgggtccctgactaggagagacctcccaacagcgacacctcataccagagagttccagctgkcatcaggccggtgcccccctgggacataacttttggaggaaggagcaggcagcaatccttgctgttgtgcagcctctgctggtgataccaggcaaacagggtctggagtggacctccagcaaactgcaacagacttgcaaaagagagacctaaccatgagaaaaaaactaacagaaagcaataacatcaacatcagcaaaacggaccccccctccacaaaaacccagtccaaaggtcatcagcctcaaagatcaaaggtagacaaatccacaaagatgaggaaaaaccagcacaaaaatg

SEQ ID NO: 82570 - DNA, 601 bp, Human
tttacatatttaaagtcaccttatttttgacacaaaggccagcaatatacattggggaatgtatgttcataattgatgctgggaaatgtggatattaatgtgctgtatgaaaaatcaattcaaaatggattaaatatttaaatgtaagacccccagctttaaaactatcacagaaaaacatagggaaaacacttgtggacatcagtccaggcaacaatttgatgggtaaaacttcaatagcacactcaacaaaagcaaaaatagacaaatgagactgttaaactaaaaggtttttgtgcarcaaaggaaaaaaccaacagaatggagagtcatcttatgtaatgggataatgtatttgcaagctattcaactgacaaaggactaatattcagaatatacaagagtctcaactcaaaaacaaacaaacaatcttatttaaaaaatgggcaaaatatatgaatagacgtttctcaaaagaagacatacaaatggctaacaagtatataaaaaatgctcaacatgtcttagatctggcagaatgaccgaataggaacagctctggtctgtagctcccagtgagaccaacacagaagatgatttc

SEQ ID NO: 82571 - DNA, 601 bp, Human
ccctaaactggacttactctagtgggtaagattgacttgcactcaaagcataaaagcaaaggcctggagaggagtggaagaatggagcactgaacactgaaatatgtagcccaagattgcacattggaagatttcaaacttttatccatgaagaatttcctttcatgtcacccaagattgcacattttatgtagcccaagattgcacattggaagatttcaaacttttatccgtgaagaatttcctttcatgtcacttatgtgaaatgagttgagttttaattttataaaaaatgacctgwcagtaaaaaacagacacgtagaccaatggaacagaatagagaattcagaaataaatttacatatttaaagtcaccttatttttgacacaaaggccagcaatatacattggggaatgtatgttcataattgatgctgggaaatgtggatattaatgtgctgtatgaaaaatcaattcaaaatggattaaatatttaaatgtaagacccccagctttaaaactatcacagaaaaacatagggaaaacacttgtggacatcagtccaggcaacaatttgatgggtaaaacttcaatagcacac

SEQ ID NO: 82572 - DNA, 601 bp, Human
aatgaacagactgaatttcaggtgtggaatgttttgatagtaagcttattttcacacaaagagctctatgcagctgcccgtagagtgcatagcaagagggattcagtgattcagctggggtcactgagtctcatatcaaatggatgcaagacctgcaagctagaaaaacaaccatatgcatgtgtgtgtatagagagcaaatacactgcatgcacagcactgtactaggtgctgagaagtgtatgaagatgaattagacacaggcactgccctaaactggacttactctagtgggtaagaytgacttgcactcaaagcataaaagcaaaggcctggagaggagtggaagaatggagcactgaacactgaaatatgtagcccaagattgcacattggaagatttcaaacttttatccatgaagaatttcctttcatgtcacccaagattgcacattttatgtagcccaagattgcacattggaagatttcaaacttttatccgtgaagaatttcctttcatgtcacttatgtgaaatgagttgagttttaattttataaaaaatgacctgacagtaaaaaacagacacgtagaccaatggaa

SEQ ID NO: 82573 - DNA, 601 bp, Human
ctttgcatcatagacaaggtaaaggattaagtgctgtgcttttagatacgcatacacataaacatctcaatgctttacaaagcagtattgctgcccgcatgtcccacctccagccttaaggtggtttttccctatctcagtagatggaacatacaatcgggttttataccgagacattccattgcccagggacgggcaggagacagatgccttcctcttgtctcaactgcaagaggcatgccttcctcttatactaatcctcctcagcacagaccctttacgggtgtcgggctgggggacrgtcaggtctttcccttcccacaaggccatatttcagactatcacatggggggaaaccttggacaatacctggctttcctaggcagaggtccctgaggccttccgcagtttttgtgtccctgggtacttgagattagggagtggtgatgactcttaaggagcgtgctgccttcaagcatctgtttaacaaagcacatcttgcaccgcccttaatccatttaaccctgagtttgacacagcacatgtttcagagagcacggggttgggggtaaggtcacagaatctcaaggcagaagaattt

SEQ ID NO: 82574 - DNA, 601 bp, Human
tacagtgtcttttctcattcatactttgtaaaataattttatctaaactctttctatcatccttccttaacactgtagctcctttattattaaaactactttaaagtcttttactttttagagcataacattcttacatctgtcaaaattatttgaaccatttaaaatctctgcagattgtcctggaagtgtaggggtgggttgcccctccacacctgtgggtgtttctcgtaaggtggaacgagagacttaggaaagaaaaagacacagagacaaagtagagagaaagaaataaggggasccggggaaccagcgttcagcatatggaggatcccgccagcctctgagttcccttagtatttattgatcattcgtgggtgtttctccgagagggggatgtgtcagggtcacaagacaattgtggggagagggtcagcagacaaacacgtgaacaaaggtctttgcatcatagacaaggtaaaggattaagtgctgtgcttttagatacgcatacacataaacatctcaatgctttacaaagcagtattgctgcccgcatgtcccacctccagccttaaggtggtttttccctatctcagta

SEQ ID NO: 82575 - DNA, 601 bp, Human
ttctaagagctgtttgtgttttatgtctaattcagtaatgacttctagcatacagaataagtggcattatctctattttacagcaaaagcaaataaaatagtaaaaagcctgagtgaacatttcatttaaaaatatatttatagtgatgtggtttcactttgttgcttaggttggtcttgaactccttccttcaaatgatccccctgcctcggcctcccaaattgctgggattataggcatgagccaccagacccaaccttgtgtgagcatttctttttttttctttttctttttcttttcttttttttttttttttttgagatggagtttcactcttgttgcccaggctggagtgcagtggcacgatctcggctcactgcaacctccgcctcctgggttcaatcaattctcctgcctcagcctcccaagtagctgggactacaggcatgtaccactatcctggctaattttgtatttttagtagagatggggtttctccatggtggtcaggctggtctcgaactcccgacctcagatgatccacccaccttggcctcccaaagtgctgggattacaagtgtgagccaccaggcctggcca

SEQ ID NO: 82576 - DNA, 601 bp, Human
atttctcaaccagaagcttcaaattttttttgttgttgttggaaatcttagagaccatttgttgtctaacaaaatgcccattaggttttgaatacaatgatacatgtctcatggattgagtcaatttgagaaacctagaatgaggaggcatcatgttaattttcagctacaatttcctaaaataatagacacactctcaatggagctgcctattctttgagaggtgcagtacataaggaaaggacatgtttaacacactcatgaacacctaacccctggcacttaatgcccagcacacagycaggagggggctccatgtgttgtactcatgttctaggctcagtactgatggctttacatgaatcgcacaactgaaaactcataatatttcctcatggttttatagaaactgagcacagaaagactttattagttgtctaaaatcataacactgtaactaatctgaacccaagcactcatgatcccataccctcttcttgaaccacttcactatgctgcttatttactaagtgaaaaattgtagaaatattttatttataggttttttatttttaaatttattatagtgtgattttatttt

SEQ ID NO: 82577 - DNA, 601 bp, Human
tctttttctccttagttcacgagcactggcttctagcacttctgtgtctctcactggatccctggactaatatttcactgttccgaagttgtagggctgggatttcctcattgatgaaatatttagaagctaagcagatttgtaatggatttagagtaatatgaaactgaaagtacttcgttcaaatcactgactccactaccataaatggaattagtggagtgtgccagtgggagggtttaaagatttctcaaccagaagcttcaaattttttttgttgttgttggaaatcttagagacmatttgttgtctaacaaaatgcccattaggttttgaatacaatgatacatgtctcatggattgagtcaatttgagaaacctagaatgaggaggcatcatgttaattttcagctacaatttcctaaaataatagacacactctcaatggagctgcctattctttgagaggtgcagtacataaggaaaggacatgtttaacacactcatgaacacctaacccctggcacttaatgcccagcacacagccaggagggggctccatgtgttgtactcatgttctaggctcagtactgatggcttt

SEQ ID NO: 82578 - DNA, 601 bp, Human
tgaatgtttcctccagataataaggattaaaagatcaagaggcagataaagagagctacctaggaagttgttcaaataaaatatatttccagcgatacagctttaggatttctgttttgttctgttttccatttggtagggtaggagaaagagaaatagaaagaggaggaatagtaggagtggagaggaggataaggggctgggaatgtgtgtgtgtgtgtgtgtgtgtgtgtgtgtgtgtgtgtgtgagagagagagagagagagagagagagagagagaggagctgtcagaccagaggygatgaatgaggctagtgtcttgacaaggcattcaggggaagactttgcagaaggcaggatcaaagtagtctgagtgcatggagaggttaaagtaagcaaagatattttctgtagagatgcattacaggagaattaaagaggaaacacttttggccctgctctctactaaaagaagacaaaattggaagcacttcagtgaagcagtggggttgaatttcacttctaagggacagggatcagtgggcactaggaaattagtgagtctggactatttctaaagaaagtaatccattctgaaac

SEQ ID NO: 82579 - DNA, 601 bp, Human
cgataagatagcttctaagtcactgagggtatgaatgcaaaattgcaaatactgaatgtttcctccagataataaggattaaaagatcaagaggcagataaagagagctacctaggaagttgttcaaataaaatatatttccagcgatacagctttaggatttctgttttgttctgttttccatttggtagggtaggagaaagagaaatagaaagaggaggaatagtaggagtggagaggaggataaggggctgggaatgtgtgtgtgtgtgtgtgtgtgtgtgtgtgtgtgtgtgtgtgwgagagagagagagagagagagagagagagagaggagctgtcagaccagaggtgatgaatgaggctagtgtcttgacaaggcattcaggggaagactttgcagaaggcaggatcaaagtagtctgagtgcatggagaggttaaagtaagcaaagatattttctgtagagatgcattacaggagaattaaagaggaaacacttttggccctgctctctactaaaagaagacaaaattggaagcacttcagtgaagcagtggggttgaatttcacttctaagggacagggatcagtgggcact

SEQ ID NO: 82580 - DNA, 601 bp, Human
gaaacttaagcttcattagagtcacgataagatagcttctaagtcactgagggtatgaatgcaaaattgcaaatactgaatgtttcctccagataataaggattaaaagatcaagaggcagataaagagagctacctaggaagttgttcaaataaaatatatttccagcgatacagctttaggatttctgttttgttctgttttccatttggtagggtaggagaaagagaaatagaaagaggaggaatagtaggagtggagaggaggataaggggctgggaatgtgtgtgtgtgtgtgtgygtgtgtgtgtgtgtgtgtgtgtgagagagagagagagagagagagagagagagagaggagctgtcagaccagaggtgatgaatgaggctagtgtcttgacaaggcattcaggggaagactttgcagaaggcaggatcaaagtagtctgagtgcatggagaggttaaagtaagcaaagatattttctgtagagatgcattacaggagaattaaagaggaaacacttttggccctgctctctactaaaagaagacaaaattggaagcacttcagtgaagcagtggggttgaatttcacttct

SEQ ID NO: 82581 - DNA, 601 bp, Human
ttcactgcaatgaggattgacaaagcttctcacattgccattctggaagtggtaacaatgtaacatacttttgcaaattttataaaactatacaaccatgtgaaacacatggctagggaaccttccaagggctcctaagggtcatgtccaagagaagggccctgaaacttaagcttcattagagtcacgataagatagcttctaagtcactgagggtatgaatgcaaaattgcaaatactgaatgtttcctccagataataaggattaaaagatcaagaggcagataaagagagctacctwggaagttgttcaaataaaatatatttccagcgatacagctttaggatttctgttttgttctgttttccatttggtagggtaggagaaagagaaatagaaagaggaggaatagtaggagtggagaggaggataaggggctgggaatgtgtgtgtgtgtgtgtgtgtgtgtgtgtgtgtgtgtgtgtgagagagagagagagagagagagagagagagagaggagctgtcagaccagaggtgatgaatgaggctagtgtcttgacaaggcattcaggggaagactttgcagaaggcaggatc

SEQ ID NO: 82582 - DNA, 601 bp, Human
gatatctagaaaatataaaaaaatttacaaagcaacagaaataaacaaccagattaataaatgaacaatggacttgaatagacattctcccaaagaagatatacaagtggccaataagcacgtgaaaagatgctcaacatcactagtcattacggaaatcaaaatcaaaaccacaacgagatactacttaacttccattcgtatggccactataaaaaaaaaaaaccactgaaaataaaaaatgttggtgaggatgtagagaaattagaacccttgtgcatttctgttgagaatgtaaaayggtacagtcactgtggaaaatggtatagtgatttcttaaaaaaagttaacatgcaatgactgcatgagccagcaattccccttctgggtatattcccaaaagaagtgaaagcagggacttgaacagatattcagacacccatgttcctattagcattatttataatagacaaaaggtggaagaaatccaagtgtccattgacagatgaagagataaacaaattagtatacacgtacaattactaagccttaaaaaggaagagttttgacacatgctaacacactgatgaaccttgaagac

SEQ ID NO: 82583 - DNA, 601 bp, Human
cggggtccagctcttcatcttgtagtttctcgagctgggcaagcttcctgcggtgaacgggccgatcaaagacaaagcattttttctttgggaagaatttccggatacagagtctgggcaggttaaaagtttcatctttttgactggtacctagaaaaacatttaaaaaattataaaattgcctaatataagtgtttctgtaaagggccaaatagtaaatattttaggctcttcaggctggatggtctcttttccaagtattcaactctgttattgaagcatgacaacagctttagacaayatgtaaatgaatgggcatagcattattccaaaaaaaccttatttacaaagacagctggcaggcaggatttgccatgatttgtcttgggctgtagtttgccaatgcttggactagcacacggttcatgttttagtctatgttctttaaataaatatccattgtactccatactctatggctaagtagaagatcacaaaccctaggcagggagataaaattaacctaatcacagcatacacaaaggtgaaagaacaagaaacttgttctagaacaatgacaaatgtaatttaaaataacatc

SEQ ID NO: 82584 - DNA, 601 bp, Human
gtactagattacatagacttgtgttaattgaatgtttgcatccattttaaccccaaccaacattaggacaggaaccatatctatttcatttatatctgtatcttcagtctattcatagtaagcatttgatcaatatgtatgaaacaaatgacactattccaataaaaaagagtcatccatttagtttattttattgcagtattgttcaaaagcgctttctgtaatgctgggaatgttgtatatgtgcttttcagtgtgctagtcactaagtacgtgtaaatattagtccttgaaatacagscatgtgaattgacttttaaattttccctatttaaattatttacatttatgtttacatagacacacttgtctaggggctactctattgcatagtgcaggtccagttcactagggcaatttcaagcaatagaacttttttcctttggccttttcctagactggaaatgtgactaacaatatatgttagaaacattggtgccatctagaatttaacacaaatatagcagtagattgggatttttcaatgctgaaactaggtggaagttattctatgctcctctagtcttaaacaatgagcaga

SEQ ID NO: 82585 - DNA, 601 bp, Human
cctcacagcatcaatgtcctcagcatcacttggaagcttgctggaaatagactctcagaccctgtccgagatctattgaattagacttttgtgtttggtaagatcctcagaagatatgtatgcataccaacatttgagagttcttgtactagattacatagacttgtgttaattgaatgtttgcatccattttaaccccaaccaacattaggacaggaaccatatctatttcatttatatctgtatcttcagtctattcatagtaagcatttgatcaatatgtatgaaacaaatgacactrttccaataaaaaagagtcatccatttagtttattttattgcagtattgttcaaaagcgctttctgtaatgctgggaatgttgtatatgtgcttttcagtgtgctagtcactaagtacgtgtaaatattagtccttgaaatacaggcatgtgaattgacttttaaattttccctatttaaattatttacatttatgtttacatagacacacttgtctaggggctactctattgcatagtgcaggtccagttcactagggcaatttcaagcaatagaacttttttcctttggccttttccta

SEQ ID NO: 82586 - DNA, 601 bp, Human
aaaatgttttagaactttgggtctgtaataatacagttggtccttctgactgatgtgatcacaaatctgttgttttcaccattatggaagctaggaggaattacttccgtcaaaataaataatagttttctttccttgtggtactttagcttctatgaccctaaaccgtatacatttgagacaaaaattaccgctaactccttttgaaatagatggtccacatctttgaaggaactcctgatgaagacttcaatggcctctctctcactgtccctgtgcaggtccagcagctcctggaggstttctgtgggcagctgcaccttctggcccatctgctgttcatagtgggcaatagccttttgcactgcagctgagttctctatctgggccaaggccaggactgcgttctccatgcacggcagatccccactgctgatggcattgacgtaggtcagcaccaggctctctagacctgcatatgaagaacaaatgataatgtttctggtggtaaagaaagtctctattccatgtaattctgagcatgtcaaataccacctattttcctcacagcatcaatgtcctcagcatcacttggaagctt

SEQ ID NO: 82587 - DNA, 601 bp, Human
aagataagtaggatgaaaattttctttgtgtttggctagaatatcaaatcagtctgagaagagtgggcaggtaattttattagaagctctggttgtcagttgtatgcataagtaaagggaaaattattcaggaaaaaatgttttagaactttgggtctgtaataatacagttggtccttctgactgatgtgatcacaaatctgttgttttcaccattatggaagctaggaggaattacttccgtcaaaataaataatagttttctttccttgtggtactttagcttctatgaccctaaacygtatacatttgagacaaaaattaccgctaactccttttgaaatagatggtccacatctttgaaggaactcctgatgaagacttcaatggcctctctctcactgtccctgtgcaggtccagcagctcctggagggtttctgtgggcagctgcaccttctggcccatctgctgttcatagtgggcaatagccttttgcactgcagctgagttctctatctgggccaaggccaggactgcgttctccatgcacggcagatccccactgctgatggcattgacgtaggtcagcaccaggctctc

SEQ ID NO: 82588 - DNA, 601 bp, Human
acacatgctcctggcaagccgatcagaacatcctacttagcagtcatttttagtaggctaatatagatactgggaaaaggagagtctctgtcctgtttagattaagggctctaagtttggaactgttaatgctgtggtcccatatgggctgagcctgctggggaatgaagccatcattgagaaagcaaatatcagagtgactcagatagagggatggtgggagggagaaaactgtggggatgggggaacactggacagagagccagttcatgatgttacttgaaaccttagacccacctgwcctgtaaagccagtttgcagcctaaatcaatgaattacatttttgtttaagcagccatcattgggttcctgtctcttgcaacaggaaaagcccagctgtaatgatgacaataataactttgtgcttcatctgctaattgaatttataacttaatagttaattgactgcactctctttgatgagcacctaggacatatctggtataacagcctgtttgcatatgttattgaataaaagcatgaatgttatgcaaacaaaaaagcacatctgtatgcagtgaagcttggtcaccttggtgtt

SEQ ID NO: 82589 - DNA, 601 bp, Human
cagaaaagattaccagccattgccataaagagtaaaaccttattttctgataaaaataactgcaaaaaagaaaatcagaaataagaagcctagtgaaatacattgtattttcagttcaaaaataatttttaattgctataagaaacatcaaccactttcctaggacttttcacacataagacaaagtctacatatactaggtaaacacaagagcattattaaatgagtcaaaaatgtcaaaaaaaatcccatattctcttctggggaaactcagaaagttttcaagtatgagtgttaagarttagaaaagactatcataagctttaacattctaaataataagtaattgaattatttcagtttagttacacagcatcttttaaagtccatctttgcaaattatacgttgctataaatacattgtgtatttggcattatgtgaatttgtttaatccagtgtcaattgtctaatggtctaaagtgtcccattgaagttataatctggatgaactgaacaataagagaagttttcttcattagcccaattgtttatcactcaattcctactcctgcccatggtttcttccaccttcctctggag

SEQ ID NO: 82590 - DNA, 601 bp, Human
atcgttactatctggtattttacagaaaagattaccagccattgccataaagagtaaaaccttattttctgataaaaataactgcaaaaaagaaaatcagaaataagaagcctagtgaaatacattgtattttcagttcaaaaataatttttaattgctataagaaacatcaaccactttcctaggacttttcacacataagacaaagtctacatatactaggtaaacacaagagcattattaaatgagtcaaaaatgtcaaaaaaaatcccatattctcttctggggaaactcagaaagwtttcaagtatgagtgttaagagttagaaaagactatcataagctttaacattctaaataataagtaattgaattatttcagtttagttacacagcatcttttaaagtccatctttgcaaattatacgttgctataaatacattgtgtatttggcattatgtgaatttgtttaatccagtgtcaattgtctaatggtctaaagtgtcccattgaagttataatctggatgaactgaacaataagagaagttttcttcattagcccaattgtttatcactcaattcctactcctgcccatgg

SEQ ID NO: 82591 - DNA, 601 bp, Human
ttggaacatagccacacctattggtttatgtattttctatggctgtgtttgcactacatgcagagctgagtaattcagacagagactgtatgacctgcaaagccataaatcgttactatctggtattttacagaaaagattaccagccattgccataaagagtaaaaccttattttctgataaaaataactgcaaaaaagaaaatcagaaataagaagcctagtgaaatacattgtattttcagttcaaaaataatttttaattgctataagaaacatcaaccactttcctaggacttttsacacataagacaaagtctacatatactaggtaaacacaagagcattattaaatgagtcaaaaatgtcaaaaaaaatcccatattctcttctggggaaactcagaaagttttcaagtatgagtgttaagagttagaaaagactatcataagctttaacattctaaataataagtaattgaattatttcagtttagttacacagcatcttttaaagtccatctttgcaaattatacgttgctataaatacattgtgtatttggcattatgtgaatttgtttaatccagtgtcaattgtctaa

SEQ ID NO: 82592 - DNA, 601 bp, Human
agcaattaggaaagacaggattattaatgtggatttaatggcattagctgcttccttgcttttttctcactgtgttattttgaataaccgcatagttttttcaagattgtaatatatatagtctaatccatatgatttttatacatgtgagtaacacaatgcaggtatataaaactctgaccaatgtttctgtaaaacagagttctgcaaactatggcttatgggtgccatcctgttattgaaagtaaaaattgattggaacatagccacacctattggtttatgtattttctatggctgygtttgcactacatgcagagctgagtaattcagacagagactgtatgacctgcaaagccataaatcgttactatctggtattttacagaaaagattaccagccattgccataaagagtaaaaccttattttctgataaaaataactgcaaaaaagaaaatcagaaataagaagcctagtgaaatacattgtattttcagttcaaaaataatttttaattgctataagaaacatcaaccactttcctaggacttttcacacataagacaaagtctacatatactaggtaaacacaagagcat

SEQ ID NO: 82593 - DNA, 601 bp, Human
ctggcatatgttagagaaaagtactaaaccaagtcagatggtttggaatgtggtctaattttttatttttttttagacggagtctcgctctgtcgcccaggctggagtacagtggcgcgatctcggctcactgcaagctccgcctcctaggttcacgccattctcctgcctcagcctccagagtagctgggactacaggcgcccgccacaacgcccggctaattttttgtatttttagtagagacagggtttcaccgtgttaaccaggatgctctccatctcctgacctcatgatccgtcytcctcggtctcccaaagtgctgggattacaggcgtgagccacagcgcctggccagaatatggtctaaatattaatactaccaaactggggaggaagtaacttaattttgctgatttttcattttcttatactttattggtttacaaagaaaccattatttgcttttaatggcagagttattcttttctactgtgaagttacttcaactcataaaaatgtattttatttacacctttgtagcaatggagcttggaagaaaatataaagcatatctacatgaacatttcatctagtattctg

SEQ ID NO: 82594 - DNA, 601 bp, Human
cccggggccactgccaccgacagcaaccctctcaactttccacccgaagcagggccaccaagcatctgcatgtgcctcccatggtcctggagctggtctgcccagacgcagttctgtgtcctgaggacaggctctcacaccacccgtcacgcaaacatggtgcccagggcctggggatcatgctgcctcaactgtagctgcgggcgtgtgcccacaacatcaggaagtgtgacagcaggcccaggtcacctgccactggcacccaagcatgccatccaggagcttggtgattgttcggccmcactcgccatagcctgcacccttgcacgccattggagggcctaaggacgggaaagcaacatgcctccctggagagagcttgattctgttctggcatatgttagagaaaagtactaaaccaagtcagatggtttggaatgtggtctaattttttatttttttttagacggagtctcgctctgtcgcccaggctggagtacagtggcgcgatctcggctcactgcaagctccgcctcctaggttcacgccattctcctgcctcagcctccagagtagctgggactacaggcgcccgccacaa

SEQ ID NO: 82595 - DNA, 601 bp, Human
ggaagaaataatgtttaagttgctaacactttatgcattttcctaaaattgaatcaaacaactccttttgaaacataaccctgatatcagggaagtcgtacaacaccgtgctaaataattttatacctctaaccaaggtctgtgccctaatcagcaggaagtgccagagtgtctgtcacccattctccctcaagattgagaaatgaacaatgaaaaaagggggatttgaaaatgcagaaccagcccaatgtggttcaagtttgtgtaataaaataatgcgttgttttactgttgccacggwctcctggtttcaagttatgttacctgagcatgcccagacacactctgcatgcaaccacggtggaacctaagtacttggaccaaggagcagggctgatttaagaaggagacacctcagggcttaatctgtgatctgatcagatccagccctgacatcacctcatggcacgatgcagtcagatcttacctcattaccctctgtctataaaacctgccccaacccccagatctgagagacaaatttttagatatgctttcccccatctccttcctagttgaataaaaataaacctttccctct

SEQ ID NO: 82596 - DNA, 601 bp, Human
acctgcgtgggaactttggctattaaacctgagcattctttctgttctctggaagaaataatgtttaagttgctaacactttatgcattttcctaaaattgaatcaaacaactccttttgaaacataaccctgatatcagggaagtcgtacaacaccgtgctaaataattttatacctctaaccaaggtctgtgccctaatcagcaggaagtgccagagtgtctgtcacccattctccctcaagattgagaaatgaacaatgaaaaaagggggatttgaaaatgcagaaccagcccaatgyggttcaagtttgtgtaataaaataatgcgttgttttactgttgccacggactcctggtttcaagttatgttacctgagcatgcccagacacactctgcatgcaaccacggtggaacctaagtacttggaccaaggagcagggctgatttaagaaggagacacctcagggcttaatctgtgatctgatcagatccagccctgacatcacctcatggcacgatgcagtcagatcttacctcattaccctctgtctataaaacctgccccaacccccagatctgagagacaaatttttagata

SEQ ID NO: 82597 - DNA, 601 bp, Human
tttaaatttactccagacaggaaccagaatcaacataacctacgagactttgattagaatctaacaggtacctgagtgccttttgtaagtaaatggctctagttgctcaattggccactgctctgccaccaggatccctagaagagaccagataaacctgaagcacgtagctaatcacttccatgccgtgatggaatgcagtgctgtctgccaacaagtttgagccagtctttcaagatgcatcctgagtggctaactgggcctgcatttcaagttgagccaagggaccatttgctaacgwggggacacacacatgttctgagttcacccaaaacacataccttattattttggggcttttcagcccacctgcctctgctaatcagggctcagctgtattgacccattagaactcagctgggttgaccaatcagaactaagtgagtttggagttttaattctcaattgaatgaacagacctgattgggaacctgcgtgggaactttggctattaaacctgagcattctttctgttctctggaagaaataatgtttaagttgctaacactttatgcattttcctaaaattgaatcaaacaac

SEQ ID NO: 82598 - DNA, 601 bp, Human
ttttatgtagctatcattaatatttttcataatttctgttttgatttttttttatgagacagagtctgggtctgtcacccaggctggagtgcaggggtgcaatctcagctccctgcaacctctgcctctgcagctcaagtgatcctcctgcctaagcctcttgagtagatgggaacacaggtgtgcacaacaacctctgactaattttttttatttatttttatttttttctgtagagatggggtctcgccatgtttcccaggctggtctcaaactcctagattcaagtgatccacctgcsttggcctcccaaagtgctggcattataggcatgaggcaccatgccaggcctgttttgaaatttcatacatatttataaaacatattttcaggatgagagaatatacgaagaagttacatagcattgtgtatctgtatagaataaaaatgatctaaatcaatgtcatcagaccatggctttatagacaccatcttctagtcaaatcactcatctgtttttacccagtactcatactgtgggaaaagtgtaggggcacagaacagtgaacactttcgggaatgttggaatcattctgtatta

SEQ ID NO: 82599 - DNA, 601 bp, Human
gaatgtgtgatcttttatgtagctatcattaatatttttcataatttctgttttgatttttttttatgagacagagtctgggtctgtcacccaggctggagtgcaggggtgcaatctcagctccctgcaacctctgcctctgcagctcaagtgatcctcctgcctaagcctcttgagtagatgggaacacaggtgtgcacaacaacctctgactaattttttttatttatttttatttttttctgtagagatggggtctcgccatgtttcccaggctggtctcaaactcctagattcaagygatccacctgcgttggcctcccaaagtgctggcattataggcatgaggcaccatgccaggcctgttttgaaatttcatacatatttataaaacatattttcaggatgagagaatatacgaagaagttacatagcattgtgtatctgtatagaataaaaatgatctaaatcaatgtcatcagaccatggctttatagacaccatcttctagtcaaatcactcatctgtttttacccagtactcatactgtgggaaaagtgtaggggcacagaacagtgaacactttcgggaatgttggaat

SEQ ID NO: 82600 - DNA, 601 bp, Human
tctaaaaaggtttccagagcataaaatttgtaataaggtgtgaatgtgtgatcttttatgtagctatcattaatatttttcataatttctgttttgatttttttttatgagacagagtctgggtctgtcacccaggctggagtgcaggggtgcaatctcagctccctgcaacctctgcctctgcagctcaagtgatcctcctgcctaagcctcttgagtagatgggaacacaggtgtgcacaacaacctctgactaattttttttatttatttttatttttttctgtagagatggggtctygccatgtttcccaggctggtctcaaactcctagattcaagtgatccacctgcgttggcctcccaaagtgctggcattataggcatgaggcaccatgccaggcctgttttgaaatttcatacatatttataaaacatattttcaggatgagagaatatacgaagaagttacatagcattgtgtatctgtatagaataaaaatgatctaaatcaatgtcatcagaccatggctttatagacaccatcttctagtcaaatcactcatctgtttttacccagtactcatactgtgggaaaagtg

SEQ ID NO: 82601 - DNA, 601 bp, Human
gattcattttatcattaacttgttagactaaagtcctctgttcctttatggctgtcgactaaaggtcatcctcaattgtttgccatgtgagatttctgccatgataacttccttcatcagtatgagcaagccatgagagagagagggagataaaaaagaaaggggaggagagagagagagtgagagagtgtgtgagctaatgagaaagagagagacacatagagagagagtaagcaagcgatagagcacatgggctagcaagatggaaatttggatgatgctatgactaagattctgaggktatttgccaaaatttagttccttgaattcgttccttacatgatagtgtgagaacagatgtacttctcaaaaatcatccactgtaagattataatttagctattattccttttttatgttgtttttcattttatttttaaaaaagtaaaagtcaccaagactggagtagatctagaagggcaaaagtgaacacagtaaattaggagtctagtgtggaattccaggtgaatgacaatatggacttagactagaaagggtgaggttctattcaactctagatgcatttccaatttagagctaa

SEQ ID NO: 82602 - DNA, 601 bp, Human
ctctgtggccagtggatcctttgcctgagtttttcttgggctcactgggcttgtttcaccccttcagtctggcaggctgcgcttggcttacgctaccctcctggatcccgtgcctgccaagagtgagctgagtggggaggggtgtgtgaatgagtgagcatggggcccagccactgctcatagccaggcatgctggctgtggcagggtgggcagctccaggcactggcatgggcgctggctccctgcgaggctgaaactggaccaggcgaaccataagcagcttccatggctggcaccagrgaatgcggtggtgcccagaagcttggaatcaccagaaagtgtgaagccccaaagaggttatcacagccctggcttggggaacttctaggtctgggatccccaaagggccacagctcttctctccttctctcttctctccttctctcttctctccttctctcttctctccttctctcttctctccttctctccttctctcttctctccttcttgttgcccacaacatggtgagcaaggggggtgtttcagccttgtttgtgttacagctctttcagctctgccatttggcaagtccctagt

SEQ ID NO: 82603 - DNA, 601 bp, Human
ataacttagtaccgctatgaaactgacagtatcttctaaagctgaacatatacatttatagaaatccatttctaaatacacacacacgaagaactgaacatctgtgaactaaaagatatgcacaagaatgctcataacactactgtaatagacataaaagtgaaagtactcaaatgttcatcaagagttgagtggggctgaatgtggtggcacatgcctgtaattccagcacttcgggagggaggtcaaggcaggtgaatctctggaggccaggagttcaagaccagcctgggcaacatartgaaactctgtctctactaaaagtacaaaaattagctgggtgtgatggcacacgcctgtaatcccagctacttgggagactgaggcacaagaattgcttgtactgggaggcagagattgcagtgagcagagattgtgccacttcactccagcctgggtgacagggtgagactcttcctcaaaaaaaatagttgaatagatgatttatgatatagtcatataataaataaatactatacaacaatgagaataattgacctacagctaaacacaaaaatattgaccaatcttgcatttactc

SEQ ID NO: 82604 - DNA, 601 bp, Human
ggagggagggaggaaagggaggaaggaaagagggagagagaaaggaaagaatgggaaaaataaagaggaagagaaaaatgaagagatacatccatacatagataacataatttttcttaacaaaagtaaaataagattataagaatgtggtctgtaaataacactactgagtcaaaaaattattaaatatatgagtcatgaaaaaccacaatgtgttaccactacacatctgccaagtggaaaaaaggcaaactatattgaggcttgatgagcttgtggagcacctagaatgttcatataktactcatgtaaatataacttagtaccgctatgaaactgacagtatcttctaaagctgaacatatacatttatagaaatccatttctaaatacacacacacgaagaactgaacatctgtgaactaaaagatatgcacaagaatgctcataacactactgtaatagacataaaagtgaaagtactcaaatgttcatcaagagttgagtggggctgaatgtggtggcacatgcctgtaattccagcacttcgggagggaggtcaaggcaggtgaatctctggaggccaggagttcaagaccag

SEQ ID NO: 82605 - DNA, 601 bp, Human
agtacacacatacacacacatacaaatgattatgtgggaaagaatattaagagattgctgcaggccattatccttagcaaactaacacaggaacagaaaaccaattaccccatattctcacttataagtggaggctaaatgatgagaacacagaggggaacacacacactgggccctatcagagagtggagggtggggtggagggagagtatcaggaaaaataactaatgggcactaggtttaatacctgggtgagtaaataatctgcactaaaaccccccatgacacaagtttacctatktaacaaacctgcacatgtactcctgaacttaaaatttttcttagaaaggaaggaaaagaggaagatgaaaaggagggagggaggaaagggaggaaggaaagagggagagagaaaggaaagaatgggaaaaataaagaggaagagaaaaatgaagagatacatccatacatagataacataatttttcttaacaaaagtaaaataagattataagaatgtggtctgtaaataacactactgagtcaaaaaattattaaatatatgagtcatgaaaaaccacaatgtgttaccactacacat

SEQ ID NO: 82606 - DNA, 601 bp, Human
acatgctagaattcttgtactgttctaagtttgttattatgtctcatgtggaagtcagaatgtcctggagactgactcctggtttggctttgatataagcactggaagatgaacaagagatgaggtggtggcaaaaaatagggatgatcttagacaaactgaaacactaaaaacagcctaagtatgtttcttttctttttcttccttccttctccccttcccctttcccttccccttccttcctccctccctcccttcctctttccctttctttctttctctctttctctctttctttctytctttctttctttctttctttctttctttctttctttctttctttctttctttctttccttctttgtcttgctctgtcacctaggcatagtacagtggcatgatctcagctcactgcaacctctgcttcctgggctcaatcatcctcctatctcagcctcccaggtagctggtaccacaggcacatggctaatttttgtattttttgtagagaagggtttttggcatgttgcccaagatgtcttgaactcctgggctctagtaatccatctcccatggcctcccatattgctaggattgc

SEQ ID NO: 82607 - DNA, 601 bp, Human
aggcacatgctagaattcttgtactgttctaagtttgttattatgtctcatgtggaagtcagaatgtcctggagactgactcctggtttggctttgatataagcactggaagatgaacaagagatgaggtggtggcaaaaaatagggatgatcttagacaaactgaaacactaaaaacagcctaagtatgtttcttttctttttcttccttccttctccccttcccctttcccttccccttccttcctccctccctcccttcctctttccctttctttctttctctctttctctctttctytctctctttctttctttctttctttctttctttctttctttctttctttctttctttctttccttctttgtcttgctctgtcacctaggcatagtacagtggcatgatctcagctcactgcaacctctgcttcctgggctcaatcatcctcctatctcagcctcccaggtagctggtaccacaggcacatggctaatttttgtattttttgtagagaagggtttttggcatgttgcccaagatgtcttgaactcctgggctctagtaatccatctcccatggcctcccatattgctagga

SEQ ID NO: 82608 - DNA, 601 bp, Human
caaaaaaagttatatgtattagtgtcttgtcccaaaatttctgatagaaagggaaatatgtgtatttgtaagcagatttaaaatgactgttgaaacagagatgggactccaagaatttaagtatcagcagaaacctaagcaagaaaaaatgactgttaaatttctttgtgaaagaaattttgtttgttttgaaaaaccagatagtgagtagagggaagaggatagaacatgggagaggactgttgggaactagcaaggtagaagtgggctgggctgggctattgtggagtgaaggcttgtkgttctcctccaggttacgagatcaaagaaatctttttttttttgagacggagtttcgctcttgttgcccaggctggagtgcaatggcgcgatctcggctcaccacaacgtctgcctcctgggttcaagtgattctcctgtctcagcctcccggagatcaaagaaatcttggggaacaaactttccacgcccacatctttaacaaaatctcctacgctcgaatgtactgtttcaattgtcttacacttgggagtgagggatagatgaggcaccatgtccagctctatctcagattaaactg

SEQ ID NO: 82609 - DNA, 601 bp, Human
ttcaaagattgtcccaaatatgaagaatcccatgaacagattctgaatttcaggtatggtatgtttttatataaagctgctttttacataaagaagactctgaatttcaggtatggtatatttttatattaagctgctttttacataaagaactccaggcagtatgctgtagggtacacagcagcagagatccattgattcagctggggttacttagtctcatatagaacggaggcatgacctgcaagttacgaaaataatgaaccatattcatgtgtgtgtaaggagaacaacgctctgwgtgcacagccctgggctggatgctgagggtatgaagactaattagacacaaccactgccctcagtaggacttactccagtgggtaagagtgacttgcacccaaattataaaatcaaaggattagagagaataggaagagaaaagcactgaacactaaaatatgtagcctcagatcacaaattggaacatttgaaacttttgctcatgaggaatttaccctgatgtcacttatgtgaaatggattaaattttagatttctaaaaagtgacttgacaataagaacagacacatagaccagta

SEQ ID NO: 82610 - DNA, 601 bp, Human
ctctcttccactttttgttgtgagtgaaggatttctgatatcaattcagaacaacttgaaactgtttttattttgaacacatgtcagattgaaagtggaagcagggactagttcttcatttttgggagatagcctagatgttaagaaaactgctcttttctgtttattacgatgaggtgggaacagtttttgtgcatttggtttttacatgagactgcttgaaaaattttctagggactttttcttttaaatggtgggtagacagaagcaacatttccactttccagtttacttggtttgyagtctatggaatccttgtatccttctaatagatggtcacagaacaaattaattcataatttagtattattatacaataacttatgtatgtatgcttagtgtttcaaagattgtcccaaatatgaagaatcccatgaacagattctgaatttcaggtatggtatgtttttatataaagctgctttttacataaagaagactctgaatttcaggtatggtatatttttatattaagctgctttttacataaagaactccaggcagtatgctgtagggtacacagcagcagagatccattgat

SEQ ID NO: 82611 - DNA, 601 bp, Human
caaaactgtggaagtgaacatgttggttcgttatgctcattttcaagatttttgagatatgttatagaattttcctctgtaaatatatgcagtccctcccactccttcaagtgtttatcacgtctttcacctcctcccccaccaggtggaatcagtatttttaatcttacctccattaataggtataaaatgacatgttttctaaataagcagttttaacatttcaactcaaaaagaatatatatttagataactatcttttttttttagtaaataatgattattttattttattaaaaawttttttttattattatactttaagttttagggtacatgtgcacaatgtgcagattagttacatatgtatacatgtgccatgctggtgtgctgcaccctttaactcgtcatttagcattaggtatatctcctaatgcgatccctccccctcccccaaccccacaacagtccccagagtgtgatgttccccttcctgtgtccatgtgttctcattgttcaattcctatctatgagtgagaacatgcagtgtttggttttttgtccttgtgatagtttactgagaatcatgatttccaatttc

SEQ ID NO: 82612 - DNA, 601 bp, Human
ccattggaaaaggcagtatttgggtgggagtttcccattttttccaggtacagccagtcacagctttccttggctaggaaagggaaaccccctggccccttgcgcttcccaggtgaggcaatacccagccctgcttcagctcgccctctgtgggctgcacccattgtccaaccagtcccagtgagatgaaccatgtatctaagttggaaatgcagaaatcacccatcttctgcactgatcacgctgggagacgtagactggagctgttcctatttggccatcttggaatggaacttcttcrcgtgcactttttagaaatcatttataagtaaatagactgtgtcgtatggtactcattccatgtagctctctcgtttttctttttttaatttcagattatgtcttgtattacggaaatcattcaatttttcaccagagaataaggtgagtttcttgaagttgttgaataattctgtttctttcaagttatgttttctttttgtgttagtcttatagaaggagtgctttaagcacacagctcaagttaaaaaaaagtctaaatgggataactgcttttggcaatgaccaggagaggaaaatc

SEQ ID NO: 82613 - DNA, 601 bp, Human
ccacccagtttgagcttccccagcaactttgtttacctactcaagcctcagcaatggtggatgcccctcctcctgccaggctgctgccttgcaggtcaatctcagactgctgcactagcagtgagcaagcctccatgggcataggacccacggaatcagctgcgggatataatctcctggtgtaccgtttgctaagaccattggaaaaggcagtatttgggtgggagtttcccattttttccaggtacagccagtcacagctttccttggctaggaaagggaaaccccctggccccttgcrcttcccaggtgaggcaatacccagccctgcttcagctcgccctctgtgggctgcacccattgtccaaccagtcccagtgagatgaaccatgtatctaagttggaaatgcagaaatcacccatcttctgcactgatcacgctgggagacgtagactggagctgttcctatttggccatcttggaatggaacttcttcgcgtgcactttttagaaatcatttataagtaaatagactgtgtcgtatggtactcattccatgtagctctctcgtttttctttttttaatttcagattatgtct

SEQ ID NO: 82614 - DNA, 601 bp, Human
agtcccatatttcttggaggcattgttcatttctttttactcttttttctctaaacttctctgcccactttatttcattaatttgatcttcaatcactgataccttttcttccacttgatcaaatcagctgttgaagcttgtgcatgtgttacgtagttctcgtgccatgattttcagctccatcaggtcatctaaggtcttctctacactgtttattctagttagccattcgtctaatcttttttcaagggttttagcttccttgcaatgggttcgaacatcctcctttagctcagagawgtttgttattaccaaccttctgaagcctacttctgtcagcttgtcaaagtaattctccgtccagctttgttctcttgctggcgaggagctgtgatcctctggaagagaagaggtgctctggtttttagaattttccatttttctgctctggtttctccccatctttgtggttttatctacctttggtctttgatgttggtgacctacagatggggttttggtgtggatgtccttttttttttttttttttttttttttttttggttgatgttgacgctattcctttctgtttgatagttt

SEQ ID NO: 82615 - DNA, 601 bp, Human
gttccattctccctgtcactttcaggtacgccaatcaaacatagatttgatcttttcacatagtcccatatttcttggaggcattgttcatttctttttactcttttttctctaaacttctctgcccactttatttcattaatttgatcttcaatcactgataccttttcttccacttgatcaaatcagctgttgaagcttgtgcatgtgttacgtagttctcgtgccatgattttcagctccatcaggtcatctaaggtcttctctacactgtttattctagttagccattcgtctaatmttttttcaagggttttagcttccttgcaatgggttcgaacatcctcctttagctcagagaagtttgttattaccaaccttctgaagcctacttctgtcagcttgtcaaagtaattctccgtccagctttgttctcttgctggcgaggagctgtgatcctctggaagagaagaggtgctctggtttttagaattttccatttttctgctctggtttctccccatctttgtggttttatctacctttggtctttgatgttggtgacctacagatggggttttggtgtggatgtccttttttt

SEQ ID NO: 82616 - DNA, 601 bp, Human
ctctcttctggcttgtagagtttctgctgagagatctgctgttagtctgatgggcttccctttgtgggtagcctgacctttctctctggctgtgcttaacatttttccttcattcaaccttggtgaatctgacaattacatgtcttggagttgctcttctcaaggagtatctttgtggtggtctctgtagttcctgaatttgaatgttggcctgccttgctaggttggggaagttctcctggataatatcctgaagagtgttttccaacttggttccattctccctgtcactttcaggtaygccaatcaaacatagatttgatcttttcacatagtcccatatttcttggaggcattgttcatttctttttactcttttttctctaaacttctctgcccactttatttcattaatttgatcttcaatcactgataccttttcttccacttgatcaaatcagctgttgaagcttgtgcatgtgttacgtagttctcgtgccatgattttcagctccatcaggtcatctaaggtcttctctacactgtttattctagttagccattcgtctaatcttttttcaagggttttagcttccttgca

SEQ ID NO: 82617 - DNA, 601 bp, Human
tggtgtataggaatgcttgtgatttttgtacattgatttttgtatcctgagactttgctgaagttgcttatcagcttaaggagattttgggctgaaatgatggggttttctaaatatgcaatcatgttatctgcaaacagggacaatttgacttcctcttttcctgattgaataccctttatttctttatcttgcctggtagctgtggccagaacttccaacactatgttgaataggagtggtgagagagggcatccctgccttgtgccagttttcaaagggaatgcttccagtttttgcscattcagtatgatattcgctgtgggtttgtcataaatagttcttactatttttaggtacgttccatcaatacctagtttattgagagtttttagcatgaagggctgttgaattttgttgaaggccttttctgcatctattgagatgatcatgtggtttttgttgttggttctctttatgtgatcgattatgtttattgattgccgtattttgaaacagccttgcatcccagggatgaagttggcttgatcatggaggataagctttttgatgtgttgctgtattcggtttgccagcattt

SEQ ID NO: 82618 - DNA, 601 bp, Human
ccccaaatactagtccagtattgtaagtttttcatgagattggacaaatactaatcaattaacgattattatgagttgaaggtattatagaaaaccctgaaagtttgtaaatgttttcatttcttgccacctgaaaacaatctttctgtgagaaagtggaatatactcgttctggatgtttgcaacattctattggacagtatttgtggacagtagtataactatatcatatgacaatatagctattatgaaaagtaaagataaaggattgcatgcactttttaaattatactttaagttmgagggtacatgtgcacaatgtgcaggtttgttacataggtatacatgtgccatgttggtttgctgcacccattaacttgtcatttacattaggtgtttctcctaatgctttccctccccctgccccccaccccacgacaggccctggtgtgtaatgttccccaccccatgtcccagtgttctcactgttcaattcccacctatgagtgagaaaatgcagtgttagattttctgtccttgtgatagtttgcttagaatgatggtttccagcttcatccatatccctgcaaaggacatgaac

SEQ ID NO: 82619 - DNA, 601 bp, Human
aacaggccccagtgtgtatgttcctcaccatgtgtccatgtgttctcattattcagctcccacttataagtgagaacacagggtgtttggttttgtgtttctgtgttagtttgctgaggataatggcttccaacttccatctccatccatgaccctgcaaaggacatgatctcgttcctttttatggctgcatagttaacagctggaattctgtgtctccttcttggagggaaaacaatatgtaacagactctttagacctgttcttgcaagtgtaacatggatatgtgtccttaagaagmaaatattagtagttaatatctgaatttctctgcccatctactttactgggaaatgatagaaggttgattcaggattggtggaatcctttggtgtcattcttgaagctctttaaggtgagggactggagcactcggtgttgggactacctactcgtgcatttgtccctgagataataaacactattcacaaattttaaaatgttcaaactattatgagatcttggttggcatatcccagaactaaaagtctgcatatggtgtttagttggtaaataatatttacaagaacagatttattta

SEQ ID NO: 82620 - DNA, 601 bp, Human
gcccttaacacttggggattattacaatttaaggtgagatttggggggggacacagagccaaaccatatcaattattaatcataaaactaccacaagaaaagcataaccccaaatgacttcactggctacttctactaaacaggtaaagaataatttatacaagtttcttacaaccttgaccaaaaatagaagagcacaatttcccattcagtttgaggcaatattacaatgctatgaaacccaaagacatcataattaaagtgtagaccactacgttttatgaaaaaggatgcaaaaatyctcaataaaatactagcaaaccaaatcccacaaaagtataccaaacttatatgaagtgggatttatcccatgaaagcaagtatggtttaacatgtgaaaatcaattaatataaaacaccatgtcaacagaatgaaggacaaaaaccatataatcatctcaatatacacaggaaaagcatttgataaaatttgataccgcttcctgataaacacagtcaacacactgagaacaaaagggaacattctcaactttataatgtcctatgaagttttattttgatataattttagacttcagaa

SEQ ID NO: 82621 - DNA, 601 bp, Human
catggaagcaactaccctgtgattcaatgatctccacctggtcctgcccttaacacttggggattattacaatttaaggtgagatttggggggggacacagagccaaaccatatcaattattaatcataaaactaccacaagaaaagcataaccccaaatgacttcactggctacttctactaaacaggtaaagaataatttatacaagtttcttacaaccttgaccaaaaatagaagagcacaatttcccattcagtttgaggcaatattacaatgctatgaaacccaaagacatcatawttaaagtgtagaccactacgttttatgaaaaaggatgcaaaaatcctcaataaaatactagcaaaccaaatcccacaaaagtataccaaacttatatgaagtgggatttatcccatgaaagcaagtatggtttaacatgtgaaaatcaattaatataaaacaccatgtcaacagaatgaaggacaaaaaccatataatcatctcaatatacacaggaaaagcatttgataaaatttgataccgcttcctgataaacacagtcaacacactgagaacaaaagggaacattctcaactttat

SEQ ID NO: 82622 - DNA, 601 bp, Human
ggagcaaaggtatattggaatgaagaaacaatagcagatgttaatttgaacctctagaaataaggagaacttgtaagtaagaaaataaaaatgaaaagctctataaatgtatacctttttcttctgcttccttaaaagacataaaatactatgaattagtaatcataacagtgtattattgagtttgtaacatatatagatgtaatatatgtaataataatagcaccaaaagagggaagagccaatagttatagagttattagtataataattcagtatctcacaggaattaatttggcawaaatttcaggcatcctttggtgagttatgtatatgataatgcctagaacaattactaagaaaataatgggtctcaaatcaataacctagtcttttacattgagacactggtaaaaaaccaaactaaatctgaagcaagcagaaagaagaaaatgaaaagttttggaaattaacagagtagaaaccaatgaaataaagaatagaagaaaaaagtagagaaagtcaataaaaccaaaagctgtttttagaaaagatcaacaaaattgacaaagcttttagttagactggccaaaatgaaaca

SEQ ID NO: 82623 - DNA, 601 bp, Human
tggctagtttttgtgttttttagtagagatggggttttatcatgttggccaggctggtgtcacactcctgacctcaagtgatccacccacctcagcctccgaaagtgttgggattacaggcatgggccactacgcctggtcaaaatcttttaacctattttttcagagtatatcattgttacttttgtcataatcatttgaaccatttaaaatctctgcaaattgttgtaaaaacatatatcaaacaacaaaacatctattcaagaagacccctacaattatggtagcaatagcaagagtygatggtacttgttccacaacctgcttcttccccatcttcaattcagattgtcaaacgttccactacagctgggtatggccaagaagcctgttttccctcttctttcatcttccagtcagggataaaatatcccattaggaggggcagtctatgagcatttctcattccgtccaacaccaagttgtagaaactaaattcctggtgagtgtgaccagaagtcaagggctttcaacctcccctgccccattcatacagtggaaggtctaacccaggcttgtcagcctaagaacacgggatctc

SEQ ID NO: 82624 - DNA, 601 bp, Human
gctggagtgcagtgttgcaatcttggctcactgcagcctctgcctccagggttccagtgattctcctgcctcagcctcccaggtagcggggattacaggcacatgccaccaggcctggctagtttttgtgttttttagtagagatggggttttatcatgttggccaggctggtgtcacactcctgacctcaagtgatccacccacctcagcctccgaaagtgttgggattacaggcatgggccactacgcctggtcaaaatcttttaacctattttttcagagtatatcattgttactttygtcataatcatttgaaccatttaaaatctctgcaaattgttgtaaaaacatatatcaaacaacaaaacatctattcaagaagacccctacaattatggtagcaatagcaagagtcgatggtacttgttccacaacctgcttcttccccatcttcaattcagattgtcaaacgttccactacagctgggtatggccaagaagcctgttttccctcttctttcatcttccagtcagggataaaatatcccattaggaggggcagtctatgagcatttctcattccgtccaacaccaagttgt

SEQ ID NO: 82625 - DNA, 601 bp, Human
aatagttttattcaaactcttcctattcttcctgaacactgtagcttcatcattattaaaactactttagagtattttttttttttttttgagacggagtctcactctgtcccctaggctgaaggctggagtgcagtgttgcaatcttggctcactgcagcctctgcctccagggttccagtgattctcctgcctcagcctcccaggtagcggggattacaggcacatgccaccaggcctggctagtttttgtgttttttagtagagatggggttttatcatgttggccaggctggtgtcrcactcctgacctcaagtgatccacccacctcagcctccgaaagtgttgggattacaggcatgggccactacgcctggtcaaaatcttttaacctattttttcagagtatatcattgttacttttgtcataatcatttgaaccatttaaaatctctgcaaattgttgtaaaaacatatatcaaacaacaaaacatctattcaagaagacccctacaattatggtagcaatagcaagagtcgatggtacttgttccacaacctgcttcttccccatcttcaattcagattgtcaaacgttcc

SEQ ID NO: 82626 - DNA, 601 bp, Human
tacagctttaggttttctgttttgttctgtttttccattttgtagagtaggagaaagagaaatgggaagaggagaaatagaagtgaggaggacgaggagaaagggctggaaagatgagagagagagagagagagagagagagagagagagagagagagaaagtgccagcaagggagatgtcagacaaggtgatgagtgaagctagtgttttgccaaggaattcaggggaggagttttcagaaggtgggatctaagtcgtctgagtgcgtgggagaggttaaagtaagcaaagataccggcyttagtagtgatgcattacaggaaattctcctgtaaattctccagaggaaaaactaggccaccgccctctctctctctcaaaaaaaaaaaagaagaaaaaaaaggagaggaagctctttagcctggattatttctagagaaacaatctgaaacaaagttcaaatgtgtaataaaaagtatactgttttcatgaatgttcctctttgatgctgggtttcagttttttctttgtctataaccgtgtcagtgggctgctagtactctgcattacctttgctgttctttccttctggtgaaaaga

SEQ ID NO: 82627 - DNA, 601 bp, Human
cctccattttcaactggttatgcttatttcactgtaatgaggatccacaaaacttctcacagtgccattctggaagtggaaccaatgtaacatacttttgcaaattctatacaactacataaccatgtgaaacacatggctagggacctttccaagggctttgaaggggcacgtgcaagagaggggccctgaaacttaagcttcattagcgtcatgataaggtagcctctaactcagtgtgggtataaatgcaaaactgccaatactgaatgttgctaagaaacacgcatgcgcgcgcgcrcacacacacacacacacacacacacacacacacacacaccccaaaaaaaccaaaccaaacaaacaacagcaacaacaaaaaaccccatgaaataaggactgaaagaccaggaagcacataaagagagctacatgggaagatgtgaaaagaaaataaatttccagcaatacagctttaggttttctgttttgttctgtttttccattttgtagagtaggagaaagagaaatgggaagaggagaaatagaagtgaggaggacgaggagaaagggctggaaagatgagagagagagagagaga

SEQ ID NO: 82628 - DNA, 601 bp, Human
agagagagccccgttgcattgcaggctgctggccagatcccgcaataaataacaaatgttggtgaatatgaagagaaattagaacccttgtgcatttctgttgggaatgctaaatggtgcagtcactgtggaaaatgatacagcaattccttaaaaaatttaacatggaatgactatatgagccatcagttccacttctgggtgtatactgaaaaggagtgaaagcagggactcgaacagatattcagacacccatgatcctatcagcattatttgtaatagccaaaaggtgtaagcaacmcaagtgtcaactgacaagcgaacagataaattagtatacacatataattacttagccttgaaaaggaagaattttttatttctttatttatttttgagatggagtttcgctctatgcccaggctggagtgcaaaggcacgatcttggctcaccgcaacctctgtttcccagattcaagtgattctcctgccccagcctcctgagtagctgggattacaggcatgtgccaccatgcccagctaattttgtatttttagtaaagacggggtttctccatgttggtcaggctagtcttgaact

SEQ ID NO: 82629 - DNA, 601 bp, Human
gccatgcatggtggcaggtgcctgtaatctcacctacttgggaggctgaggtaggagaatcgcttgaacccgggaggtggaggttgcagtgagctggggtcgtgccactgcactccagcctgggtgacagagtgagactgtgtctcaaaaaaaaaaaaaattaaaataactgtagggagaccccgtgaaactattgctatggaataaaagatgaaatgctcctgattattgtaaatacaaaattgcatgcaggattgtgcaaagacagtgccaggttggactgccagaatgagccaacggsacgtgatgtgcttccccctgcagagagcctatgaatggatgtgcagtcagggaggtttcacatcaccaagattcctatcccagaaaagcagatgttcatagctctgggaatggaatgagacccttgtggagagagggggcacctgtccatgtggataagatagggccataaacgcattcatcttgccatggctcttctaggcctctttagggttaaggcatactcccttctgagaatttctggtctaaccggttgtctagcttcacgtcttgtttctatggattgtttgtaaccagcttt

SEQ ID NO: 82630 - DNA, 601 bp, Human
gaaaccccatttacactaaaaatacaaaactgagccatgcatggtggcaggtgcctgtaatctcacctacttgggaggctgaggtaggagaatcgcttgaacccgggaggtggaggttgcagtgagctggggtcgtgccactgcactccagcctgggtgacagagtgagactgtgtctcaaaaaaaaaaaaaattaaaataactgtagggagaccccgtgaaactattgctatggaataaaagatgaaatgctcctgattattgtaaatacaaaattgcatgcaggattgtgcaaagacartgccaggttggactgccagaatgagccaacgggacgtgatgtgcttccccctgcagagagcctatgaatggatgtgcagtcagggaggtttcacatcaccaagattcctatcccagaaaagcagatgttcatagctctgggaatggaatgagacccttgtggagagagggggcacctgtccatgtggataagatagggccataaacgcattcatcttgccatggctcttctaggcctctttagggttaaggcatactcccttctgagaatttctggtctaaccggttgtctagcttcacg

SEQ ID NO: 82631 - DNA, 601 bp, Human
cctgaaaagatgctcaacattactagtcattaggaaaatgcaaattaaagccatagtgagatactacttcacatccattagtatggtgactatcaaaaaaaattgaaaagggctgggtgcagtggctcaagcctgaaatcccagcactttgggaggctgaggcaggtggatcacctgaggtcaggagtttgagaccggcctggcaaatatggagaaaccccatttacactaaaaatacaaaactgagccatgcatggtggcaggtgcctgtaatctcacctacttgggaggctgaggtagragaatcgcttgaacccgggaggtggaggttgcagtgagctggggtcgtgccactgcactccagcctgggtgacagagtgagactgtgtctcaaaaaaaaaaaaaattaaaataactgtagggagaccccgtgaaactattgctatggaataaaagatgaaatgctcctgattattgtaaatacaaaattgcatgcaggattgtgcaaagacagtgccaggttggactgccagaatgagccaacgggacgtgatgtgcttccccctgcagagagcctatgaatggatgtgcagtcagggag

SEQ ID NO: 82632 - DNA, 601 bp, Human
ctagaaatgaactctcacatctatagtcaaaaaattttcaacatggatgctaaaatcattcaacgcagaaagaggagtctctacaacaaatgacattgggaaaactggatattcacatgctcacatgccaaaaaaaaaaaaaaagttggactgttagcttacacaatccaaaacgtaactcaaaatggatcaaagaactaaccattagagctaaaactataaaactcatgggagaaaacaaaggggaaaaacagacagtaaaaggaaaaacagataactttgacttcatcaaaatgaaaarcttttgtgcatcaaatgacactatcaacagaataaaaaggcaacacatggaatggaagaaaacatttgctaaacgtgtatctgataaggaattgatgtctagcaaatataaagaattcctacaatgcaacacaaacagattaaaaagtaaagaaagaacttgaatagacatttctctaaagaatggccaataagcacctgaaaagatgctcaacattactagtcattaggaaaatgcaaattaaagccatagtgagatactacttcacatccattagtatggtgactatcaaaaaaaatt

SEQ ID NO: 82633 - DNA, 601 bp, Human
cataaggagataaaatttacctaaattgtaaaataggaaaaaatgaaagaaaaagaaacttattttagaacacaggagaatataatttaaaatctaatctattaatttagatattcagcaagcattcattccttttttccttttttcaaaaaaccttttctattgctaatagcaagcattaattcttaagaatagcaagctagagatatagaaaactgtaaatgtgagaaaactatcaatagtaaactaaaaaatgataatttctagtgttttgtcgtcctcatttatcaatggtacgtcyctgttaccttgcgttagcttcagggaatactccaggtactcatctggtgtgaggggttgtccatctgcttccaagtccagggagaaatctctcagtgtccacacaaaatctgggaagaagctcacaaagtcagctgaatcctcattctcattctcatcaggtgaggattttgatcggattcgatgtgtcagctctgtcacatagctgagtagctaactaaggaaatgtgacaaaatgaacaggaacctcatcccatattagttcaacacattcccaaaccttccattttcctttgatcct

SEQ ID NO: 82634 - DNA, 601 bp, Human
gcctcccaaagtgctgggattacaggcatgaaccatcatgcctggccatcctttagttttaacaatgagtggaagtactacgaaggggacttacgaggcccattgaccttgatgcctcctgaaagagttttagttttggaattgctaaagatgtaggaacagaagtctgctacttgttgcacaaattcagggtccagctcttcatcttgtagtttctcaagctgggcaagcttcctgcggtgaatgggcagatcgaagacaaaacattttttctttgggaagaacttccggatacagagtyggggcagattaaaatttttatctttttgactggtacctagagaaacataataaagaaatttgcctaatataagtgtttccgtaaagcgtcaaatagtaaatattttaggctctgcaggctaggtggtctcttttccaagtactcaactttgttattggagcatgacaacagctttagacaatatgtaaatgaatgggcatagcattcttcccaaaaaacctcacttagaaagacagctggcaggcagaattggccatcatttgtcttaggctgcagttcgccagcatttggactagtaca

SEQ ID NO: 82635 - DNA, 601 bp, Human
tgccctcctcggcctcccaaagtgctgggattacaggcatgaaccatcatgcctggccatcctttagttttaacaatgagtggaagtactacgaaggggacttacgaggcccattgaccttgatgcctcctgaaagagttttagttttggaattgctaaagatgtaggaacagaagtctgctacttgttgcacaaattcagggtccagctcttcatcttgtagtttctcaagctgggcaagcttcctgcggtgaatgggcagatcgaagacaaaacattttttctttgggaagaacttccrgatacagagtcggggcagattaaaatttttatctttttgactggtacctagagaaacataataaagaaatttgcctaatataagtgtttccgtaaagcgtcaaatagtaaatattttaggctctgcaggctaggtggtctcttttccaagtactcaactttgttattggagcatgacaacagctttagacaatatgtaaatgaatgggcatagcattcttcccaaaaaacctcacttagaaagacagctggcaggcagaattggccatcatttgtcttaggctgcagttcgccagcattt

SEQ ID NO: 82636 - DNA, 601 bp, Human
tctgtcacccaggctggagtgcagtggcgtgatctcgtctcactgcaacctctgcctcccaggttcaagcaattctcctgcctcagcctcccaagtagctgggattacaggtatgtgccaccatgcctcatttatttttgtatttttagtagagacatggttttgccatgtgggctaggttggtctcaaactcctggcctcaagtgatctgccctcctcggcctcccaaagtgctgggattacaggcatgaaccatcatgcctggccatcctttagttttaacaatgagtggaagtactasgaaggggacttacgaggcccattgaccttgatgcctcctgaaagagttttagttttggaattgctaaagatgtaggaacagaagtctgctacttgttgcacaaattcagggtccagctcttcatcttgtagtttctcaagctgggcaagcttcctgcggtgaatgggcagatcgaagacaaaacattttttctttgggaagaacttccggatacagagtcggggcagattaaaatttttatctttttgactggtacctagagaaacataataaagaaatttgcctaatataagtgtttcc

SEQ ID NO: 82637 - DNA, 601 bp, Human
tcctggagggtttctgcgggcagctgcaccttctggcccatctgctggtcatagtgggcaatagccttttgcactgcggctgagttctctatctgggccaaggccaggactgcgttctccatgcagggcagatcccctctgctgatagcattgatataggtcagcactaggctctctagacctacatacaaagaagaaatgataatgtttcttgtactaaagaaaactctctattctgtgtaattctgaacatgtcaatttccacctattttcctcacagcatcaaggtcctcagaatcayctggaagcttgctggaaatgcctattgttagcctctgtcccagatctactgaattagagttttttctttgggtaagatccctagatgatatgtatgcatatcaacatttgagaatccttgttctagatgacctagtcctgtgttagttgaatgtttgcatccatttcaaccccaagcaccatcaggaaaggaacccatagctattccatatatgactgtatcctcagcttattcacagtagcatttgatcaatacttatggaacaaatgatactctcctaatcaaaaggagccctccgtt

SEQ ID NO: 82638 - DNA, 601 bp, Human
aggccagagtgctgaggtgcaatcttggctcactgaacctcccgggctcaagcaattctcctgcctcagccttctgagtagctgggactacaggcatgtgcaacagtgcccagctaatttttatattcttactagagacatgtttcaccatgttgctcaggctggtcttaaactcctgagctcaagcaatctgcctgcctctgccctcaaagtgttaggattacaggcttgagccaccgcacccgccgactgcactctctttgatgagcacctgggacatacctgatataacagtctccccgcatatgttattgaatgaaagcatgaatgttatacagacaaaaaagcacatctgtgtgcagtgaagcttggtcactttggtgttcgtaggaggtaggtcagcaggtttccataatcgacagatgaatcttggttacctgtatccccttccttggttcctcatagtactttttctccaggtcttgtagcttctgaataaagagacaatagccccctggtttcgaataaattcccgccttcacttcttcttctagaggactgaaaatgacctgaagtaaagctgagcaacgatctgatgatg
